(12) United States Patent
Feng et al.

(10) Patent No.: US 6,730,303 B1
(45) Date of Patent: *May 4, 2004

(54) FUSED G-CSF AND IL-3 PROTEINS AND USES THEREOF

(75) Inventors: Yiqing Feng, St. Louis, MO (US); Nicholas R. Staten, St. Louis, MO (US); Charles M. Baum, Evanston, IL (US); Neena L. Summers, St. Charles, MO (US); Maire Helena Caparon, Chesterfield, MO (US); S. Christopher Bauer, New Haven, MO (US); Linda L. Zurfluh, Kirkwood, MO (US); John P. McKearn, Glencoe, MO (US); Barbara K. Klein, St. Louis, MO (US); Stephen C. Lee, St. Louis, MO (US); Charles A. McWherter, Wildwood, MO (US); Judith G. Giri, Chesterfield, MO (US)

(73) Assignee: Pharmacia Corporation, St. Louis, MO (US)

( * ) Notice: Subject to any disclaimer, the term of this patent is extended or adjusted under 35 U.S.C. 154(b) by 0 days.

This patent is subject to a terminal disclaimer.

(21) Appl. No.: 09/510,238

(22) Filed: Feb. 22, 2000

Related U.S. Application Data

(60) Division of application No. 08/835,162, filed on Apr. 4, 1997, now Pat. No. 6,066,318, which is a continuation-in-part of application No. 08/836,659, filed as application No. PCT/US96/15774 on Oct. 4, 1996.
(60) Provisional application No. 60/004,834, filed on Oct. 5, 1995.

(51) Int. Cl.[7] .............................................. C07K 19/00
(52) U.S. Cl. ................ 424/192.1; 424/85.1; 424/198.1; 424/93.21; 424/85.2; 530/351; 530/399; 536/23.4; 435/69.7; 435/69.9; 435/320.1; 435/235; 435/252.3
(58) Field of Search .......................... 424/85.1, 192.1, 424/198.1, 93.21, 85.2; 536/23.4; 435/69.7, 69.9, 320.1, 235, 252.3; 530/351, 399

(56) References Cited

U.S. PATENT DOCUMENTS

| | | |
|---|---|---|
| 4,810,643 A | 3/1989 | Souza |
| 4,877,729 A | 10/1989 | Souza |
| 4,959,455 A | 9/1990 | Clark et al. |
| 4,999,291 A | 3/1991 | Souza |
| 5,399,345 A | 3/1995 | Schumacher et al. |
| 5,738,849 A * | 4/1998 | Bauer et al. ............. 424/192.1 |
| 6,100,070 A * | 8/2000 | Zurfluh et al. ............. 435/69.5 |

FOREIGN PATENT DOCUMENTS

| | | |
|---|---|---|
| EP | 0 225 579 B1 | 6/1987 |
| EP | 0 675 201 | 10/1995 |
| EP | 0 783 003 A1 | 10/1996 |
| WO | WO 90/12877 | 11/1990 |
| WO | WO 92/04455 | 3/1992 |
| WO | WO 92/06116 | 4/1992 |
| WO | WO 95/18858 | 7/1995 |
| WO | WO 95/21197 | 8/1995 |
| WO | WO 95/21254 | 8/1995 |
| WO | WO 95/27732 | 10/1995 |

OTHER PUBLICATIONS

Reeke et al, "Three–Dimensional Structure of Favin: Saccharide Binding–Cyclic Permutation in Leguminous Lectins", Science, Nov. 28, 1986, vol. 234 pp 1108–1111.

Luger et al, "An 8–fold Ba Barrel Protein with Redundant Folding Possibilities", Protein Engineering, vol. 3 pp 249–258.

Cunningham et al, "Favion versus concanavalin A: Circularly permuted amino acid sequences", Proc. Natl. Acad. Sci. USA, Jul. 1979, vol. 76, No. 7, pp. 3218–3222.

Protasova et al, Circularly permuted dihydrofolate reductase of E.coli has functional activity and a destabilized tertiary structure:, Protein Engineering, 1994, vol. 7, No. 11, pp. 1373–1777.

Zhang et al, "Circular Permutation of T4 Lysozyme", Biochemistry, vol. 32, No. 46, 1993.

Luger et al, "Correct Folding of Circularly Permuted Variants of a Ba Barrel Enzyme in Vivo", Science, vol. 243.

Hahn et al, "Native–like in vivo folding of a circularly permuted jellyroll protein shown by crystal structure analysis", Proc. Natl. Acad. Sci. USA, 1994, vol. 91, pp. 10417–10421.

Lin et al, "Rearranging the domains of pepsinogen", Protein Science, 1995, vol. 4, pp 159–166.

Yang et al, "Aspartate transcarbamoylase containing circularly permuted catalytic polypeptide chains", Proc. Natl. Acad. Sci. USA, 1993, vol. 90, pp. 11980–11984.

Vignai et al, "Circular permutation within the coenzyme binding domain of the tetrameric glyceraldehyde–3–phosphate dehydrogenase from *Bacillus stearothermophilus*", Protein Science, 1995, vol. 4., pp. 994–1000.

Goldenberg et al, "Circular and Circularly Permuted Forms of Bovine Pancreatic Trypsin Inhibitor", J. Mol. Biol. 1983, vol. 165, pp. 407–413.

(List continued on next page.)

Primary Examiner—Lorraine Spector
(74) Attorney, Agent, or Firm—S. Christopher Bauer; Pharmacia Corporation

(57) ABSTRACT

Disclosed are novel multi-functional hematopoietic receptor agonist proteins, DNAs which encode the multi-functional hematopoietic receptor agonists proteins, methods of making the multi-functional hematopoietic receptor agonists proteins and methods of using the multi-functional hematopoietic receptor agonists proteins.

27 Claims, 4 Drawing Sheets

OTHER PUBLICATIONS

Hemperly et al, "Circular permutation of amino acid sequences among legume lectins", TIBS, 1983, pp. 100–102.

Kreitman et al, "Circularly permuted interleukin 4 retains proliferative and binding activity", Cytokine, 1995, vol. 7, No. 4, pp. 311–318.

Li et al, "Degradation of Ornithine Decarboxylase", Mol. and Cel. Biol. 1993, vol. 13, No. 4, pp. 2377–2383.

Ritco et al, "Is the Continuity of the Domains Required for the Correct Folding of a Two–Domain Protein?", Biochemistry, 1995, vol. 34, pp. 16543–16551.

Garrett et al, "Are turns required for the folding of ribonuclease T1?", Protein Science, 1996, vol. 5., pp. 204–211.

Komar et al, "Kinetics of translation" FEBS Letters, 1995 vol. 376, pp. 195–198.

MacGregor et al, "A circularly permuted a–amylase–type", FEBS Letters, 1996, vol. 378, pp. 263–266.

Koebnik et al, "Membrane Assembly of Circulary Permuted Variants", JMB, 1995, vol. 250, pp. 617–626.

Buchwalder et al, "A fully active variant of Dihydrofolate Reductase with a circularly permuted sequence", Biochemistry, 1992, vol. 31, pp. 1621–1630.

Viguera et al, "The order of secondary structure elements", J. Mol. Biol., 1995, vol. 247, pp. 670–681.

Mullins et al. "Transposition of Protein Sequences: Circular Permutation of Ribonuclease T1", J. Am. Chem. Soc., 1994, vol. 116, pp. 5529–5533.

Horlick et al, "Permuteins of interleukin 1B—a simplified approach for the construction of permutated proteins having new termini", Protein Engineering, USA, 1992, vol. 5, pp. 427–431.

Kreitman et al, "A circularly permuted recombinant interleukin 4 toxin with increase activity", Proc. Natl. Acad. Sci. USA, 1993, vol. 91, pp. 6889–3893.

Watanabe et al, "Mutant Protein of Recombinant Human Granulocyte Colony–Stimulating Factor . . . ", Analytical Biochemistry, 1991, vol. 195 pp 38–44.

* cited by examiner

FIG.4
I. Construct tandemly-duplicated template
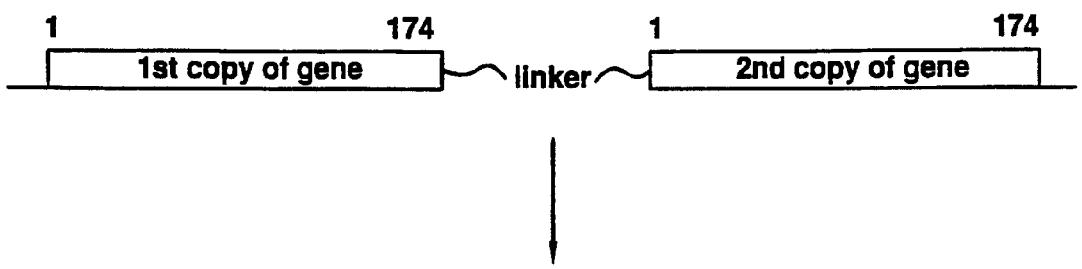
II. PCR-amplify tandemly-duplicated template
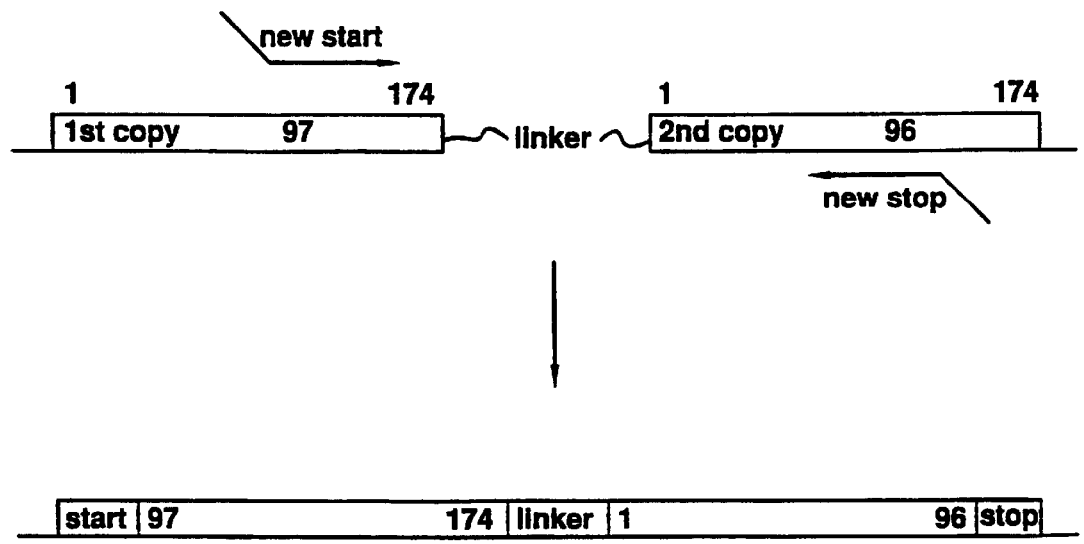

FUSED G-CSF AND IL-3 PROTEINS AND USES THEREOF

The present application is a divisional of U.S. Ser. No. 08/835,162 filed Apr. 4, 1997 and issued as U.S. Pat. No. 6,066,318 which is a Continuation-in-Part of U.S. Ser. No. 08/836,659 which was filed as PCT/US 96/15774 on Oct. 4, 1996 which claims priority under 35 USC §119(e) of U.S. provisional application Ser. No. 60/004,834 filed Oct. 5, 1995.

The present application is a Continuation-in-Part of PCT/US 96/15774 filed Oct. 4, 1996 which claims priority under 35 USC §119(e) of U.S. provisional application Ser. No. 60/004,834 filed Oct. 5, 1995.

FIELD OF THE INVENTION

The present invention relates to multi-functional hematopoietic receptor agonists.

BACKGROUND OF THE INVENTION

Colony stimulating factors (CSFs) which stimulate the differentiation and/or proliferation of bone marrow cells have generated much interest because of their therapeutic potential for restoring depressed levels of hematopoietic stem cell-derived cells. CSFs in both human and murine systems have been identified and distinguished according to their activities. For example, granulocyte-CSF (G-CSF) and macrophage-CSF (M-CSF) stimulate the in vitro formation of neutrophilic granulocyte and macrophage colonies, respectively, while GM-CSF and interleukin-3 (IL-3) have broader activities and stimulate the formation of both macrophage, neutrophilic and eosinophilic granulocyte colonies. IL-3 also stimulates the formation of mast, megakaryocyte and pure and mixed erythroid colonies.

U.S. Pat. No. 4,877,729 and U.S. Pat. No. 4,959,455 disclose human IL-3 and gibbon IL-3 cDNAs and the protein sequences for which they code. The hIL-3 disclosed has serine rather than proline at position 8 in the protein sequence. International Patent Application (PCT) WO 88/00598 discloses gibbon- and human-like IL-3. The hIL-3 contains a $Ser^8 \rightarrow Pro^8$ replacement. Suggestions are made to replace Cys by Ser, thereby breaking the disulfide bridge, and to replace one or more amino acids at the glycosylation sites.

U.S. Pat. No. 4,810,643 discloses the DNA sequence encoding human G-CSF.

WO 91/02754 discloses a fusion protein comprised of GM-CSF and IL-3 which has increased biological activity compared to GM-CSF or IL-3 alone. Also disclosed are nonglycosylated IL-3 and GM-CSF analog proteins as components of the multi-functional hematopoietic receptor agonist.

WO 92/04455 discloses fusion proteins composed of IL-3 fused to a lymphokine selected from the group consisting of IL-3, IL-6, IL-7, IL-9, IL-11, EPO and G-CSF.

WO 95/21197 and WO 95/21254 disclose fusion proteins capable of broad multi-functional hematopoietic properties.

GB 2,285,446 relates to the c-mpl ligand (thrombopoietin) and various forms of thrombopoietin which are shown to influence the replication, differentiation and maturation of megakaryocytes and megakaryocytes progenitors which may be used for the treatment of thrombocytopenia.

EP 675,201 A1 relates to the c-mpl ligand (Megakaryocyte growth and development factor (MGDF), allelic variations of c-mpl ligand and c-mpl ligand attached to water soluble polymers such as polyethylene glycol.

WO 95/21920 provides the murine and human c-mpl ligand and polypeptide fragments thereof. The proteins are useful for in vivo and ex vivo therapy for stimulating platelet production.

Rearrangement of Protein Sequences

In evolution, rearrangements of DNA sequences serve an important role in generating a diversity of protein structure and function. Gene duplication and exon shuffling provide an important mechanism to rapidly generate diversity and thereby provide organisms with a competitive advantage, especially since the basal mutation rate is low (Doolittle, Protein Science 1:191–200, 1992).

The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., Proc. Natl. Acad. Sci. U.S.A. 76:3218–3222, 1979; Teather & Erfle, J. Bacteriol. 172: 3837–3841, 1990; Schimming et al., Eur. J. Biochem. 204: 13–19, 1992; Yamiuchi and Minamikawa, FEBS Lett. 260:127–130, 1991; MacGregor et al., FEBS Lett. 378:263–266). The first in vitro application of this type of rearrangement to proteins was described by Goldenberg and Creighton (J. Mol. Biol. 165:407–413, 1983). A new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus, and the new sequence continues with the same sequence as the original until it reaches a point that is at or near the amino acid that was N-terminal to the breakpoint site of the original sequence, this residue forming the new C-terminus of the chain.

This approach has been applied to proteins which range in size from 58 to 462 amino acids (Goldenberg & Creighton, J. Mol. Biol. 165:407–413, 1983; Li & Coffino, Mol. Cell. Biol. 13:2377–2383, 1993). The proteins examined have represented a broad range of structural classes, including proteins that contain predominantly α-helix (interleukin-4; Kreitman et al., Cytokine 7:311–318, 1995), β-sheet (interleukin-1; Horlick et al., Protein Eng. 5:427–431, 1992), or mixtures of the two (yeast phosphoribosyl anthranilate isomerase; Luger et al., Science 243:206–210, 1989). Broad categories of protein function are represented in these sequence reorganization studies:

| Enzymes | |
|---|---|
| T4 lysozyme | Zhang et al., Biochemistry 32:12311-12318, 1993; Zhang et al., Nature Struct. Biol. 1:434-438 (1995) |
| dihydrofolate reductase | Buchwalder et al., Biochemistry 31:1621-1630, 1994; Protasova et al., Prot. Eng. 7:1373-1377, 1995) |
| ribonuclease T1 | Mullins et al., J. Am. Chem. Soc. 116:5529-5533, 1994; Garrett et al., Protein Science 5:204-211, 1996) |

| | |
|---|---|
| Bacillus β-glucanse | Hahn et al., Proc. Natl. Acad. Sci. U.S.A. 91:10417-10421, 1994) |
| aspartate transcarbamoylase | Yang & Schachman, Proc. Natl. Acad. Sci. U.S.A. 90:11980-11984, 1993) |
| phosphoribosyl anthranilate isomerase | Luger et al., Science 243:206-210 (1989; Luger et al., Prot. Eng. 3:249-258, 1990) |
| pepsin/pepsinogen | Lin et al., Protein Science 4:159-166, 1995) |
| glyceraldehyde-3-phosphate dehydrogenase | Vignais et al., Protein Science 4:994-1000, 1995) |
| ornithine decarboxylase | Li & Coffino, Mol. Cell. Biol. 13:2377-2383, 1993) |
| yeast phosphoglycerate dehydrogenase | Ritco-Vonsovici et al., Biochemistry 34:16543-16551, 1995) |
| Enzyme Inhibitor | |
| basic pancreatic trypsin inhibitor | Goldenberg & Creighton, J. Mol. Biol. 165:407-413, 1983) |
| Cytokines | |
| interleukin-1β | Horlick et al., Protein Eng. 5:427-431, 1992) |
| interleukin-4 | Kreitman et al., Cytokine 7:311-318, 1995) |
| Tyrosine Kinase Recognition Domain | |
| α-spectrin SH3 domain | Viguera, et al., J. Mol. Biol. 247:670-681, 1995) |
| Transmembrane Protein | |
| omp A | Koebnik & Krämer, J. Mol. Biol. 250:617-626, 1995) |
| Chimeric Protein | |
| interleukin-4-Pseudomonas exotoxin | Kreitman et al., Proc. Natl. Acad. Sci. U.S.A. 91:6889-6893, 1994). |

The results of these studies have been highly variable. In many cases substantially lower activity, solubility or thermodynamic stability were observed (*E. coli* dihydrofolate reductase, aspartate transcarbamoylase, phosphoribosyl anthranilate isomerase, glyceraldehyde-3-phosphate dehydrogenase, ornithine decarboxylase, omp A, yeast phosphoglycerate dehydrogenase). In other cases, the sequence rearranged protein appeared to have many nearly identical properties as its natural counterpart (basic pancreatic trypsin inhibitor, T4 lysozyme, ribonuclease T1, Bacillus β-glucanase, interleukin-1β, α-spectrin SH3 domain, pepsinogen, interleukin-4). In exceptional cases, an unexpected improvement over some properties of the natural sequence was observed, e.g., the solubility and refolding rate for rearranged α-spectrin SH3 domain sequences, and the receptor affinity and anti-tumor activity of transposed interleukin-4-Pseudomonas exotoxin fusion molecule (Kreitman et al., *Proc. Natl. Acad. Sci. U.S.A.* 91:6889–6893, 1994; Kreitman et al., *Cancer Res.* 55:3357–3363, 1995).

The primary motivation for these types of studies has been to study the role of short-range and long-range interactions in protein folding and stability. Sequence rearrangements of this type convert a subset of interactions that are long-range in the original sequence into short-range interactions in the new sequence, and vice versa. The fact that many of these sequence rearrangements are able to attain a conformation with at least some activity is persuasive evidence that protein folding occurs by multiple folding pathways (Viguera, et al., *J. Mol. Biol.* 247:670–681, 1995). In the case of the SH3 domain of α-spectrin, choosing new termini at locations that corresponded to β-hairpin turns resulted in proteins with slightly less stability, but which were nevertheless able to fold.

The positions of the internal breakpoints used in the studies cited here are found exclusively on the surface of proteins, and are distributed throughout the linear sequence without any obvious bias towards the ends or the middle (the variation in the relative distance from the original N-terminus to the breakpoint is ca. 10 to 80% of the total sequence length). The linkers connecting the original N- and C-termini in these studies have ranged from 0 to 9 residues. In one case (Yang & Schachman, *Proc. Natl. Acad. Sci. U.S.A.* 90:11980–11984, 1993), a portion of sequence has been deleted from the original C-terminal segment, and the connection made from the truncated C-terminus to the original N-terminus. Flexible hydrophilic residues such as Gly and Ser are frequently used in the linkers. Viguera, et al. (*J. Mol. Biol.* 247:670–681, 1995) compared joining the original N- and C-termini with 3- or 4-residue linkers; the 3-residue linker was less thermodynamically stable. Protasova et al. (*Protein Eng.* 7:1373–1377, 1994) used 3- or 5-residue linkers in connecting the original N-termini of *E. coli* dihydrofolate reductase; only the 3-residue linker produced protein in good yield.

SUMMARY OF THE INVENTION

Novel hematopoietic proteins of this invention are represented by the formulas:

$$R_1—L_1—R_2, R_2—L_1—R_1, R_1—R_2, \text{ or } R_2—R_1$$

wherein $R_1$ and $R_2$ are independently selected from the group consisting of;

(I) A polypeptide comprising; a modified human G-CSF amino acid sequence of the formula:

```
                                                           (SEQ ID NO:1)
 1                              10
Xaa Xaa Xaa Gly Pro Ala Ser Ser Leu Pro Gln Ser Xaa

20
Leu Leu Xaa Xaa Xaa Glu Gln Val Xaa Lys Xaa Gln Gly Xaa Gly 30                              40
Ala Xaa Leu Gln Glu Xaa Leu Xaa Ala Thr Tyr Lys Leu Xaa Xaa

50
Xaa Glu Xaa Xaa Val Xaa Xaa Gly His Ser Xaa Gly Ile Pro Trp 60                              70
```

-continued

```
Ala Pro Leu Ser Ser Xaa Pro Ser Xaa Ala Leu Xaa Leu Ala Gly
                    80
Xaa Leu Ser Gln Leu His Ser Gly Leu Phe Leu Tyr Gln Gly Leu
 90                                  100
Leu Gln Ala Leu Glu Gly Ile Ser Pro Glu Leu Gly Pro Thr Leu
                        110
Xaa Thr Leu Gln Xaa Asp Val Ala Asp Phe Ala Xaa Thr Ile Trp
    120                              130
Gln Gln Met Glu Xaa Xaa Gly Met Ala Pro Ala Leu Gln Pro Thr
                    140
Gln Gly Ala Met Pro Ala Phe Ala Ser Ala Xaa Gln Xaa Xaa Ala
    150                              160
Gly Gly Val Leu Val Ala Ser Xaa Leu Gln Xaa Phe Leu Xaa Xaa
                    170
Ser Tyr Arg Val Leu Xaa Xaa Leu Ala Gln Pro
``` wherein
- Xaa at position 1 is Thr, Ser, Arg, Tyr or Gly;
- Xaa at position 2 is Pro or Leu;
- Xaa at position 3 is Leu, Arg, Tyr or Ser;
- Xaa at position 13 is Phe, Ser, His, Thr or Pro;
- Xaa at position 16 is Lys, Pro, Ser, Thr or His;
- Xaa at position 17 is Cys, Ser, Gly, Ala, Ile, Tyr or Arg;
- Xaa at position 18 is Leu, Thr, Pro, His, Ile or Cys;
- Xaa at position 22 is Arg, Tyr, Ser, Thr or Ala;
- Xaa at position 24 is Ile, Pro, Tyr or Leu;
- Xaa at position 27 is Asp, or Gly;
- Xaa at position 30 is Ala, Ile, Leu or Gly;
- Xaa at position 34 is Lys or Ser;
- Xaa at position 36 is Cys or Ser;
- Xaa at position 42 is Cys or Ser;
- Xaa at position 43 is His, Thr, Gly, Val, Lys, Trp, Ala, Arg, Cys, or Leu;
- Xaa at position 44 is Pro, Gly, Arg, Asp, Val, Ala, His, Trp, Gln, or Thr;
- Xaa at position 46 is Glu, Arg, Phe, Arg, Ile or Ala;
- Xaa at position 47 is Leu or Thr;
- Xaa at position 49 is Leu, Phe, Arg or Ser;
- Xaa at position 50 is Leu, Ile, His, Pro or Tyr;
- Xaa at position 54 is Leu or His;
- Xaa at position 64 is Cys or Ser;
- Xaa at position 67 is Gln, Lys, Leu or Cys;
- Xaa at position 70 is Gln, Pro, Leu, Arg or Ser;
- Xaa at position 74 is Cys or Ser;
- Xaa at position 104 is Asp, Gly or Val;
- Xaa at position 108 is Leu, Ala, Val, Arg, Trp, Gln or Gly;
- Xaa at position 115 is Thr, His, Leu or Ala;
- Xaa at position 120 is Gln, Gly, Arg, Lys or His
- Xaa at position 123 is Glu, Arg, Phe or Thr
- Xaa at position 144 is Phe, His, Arg, Pro, Leu, Gln or Glu;
- Xaa at position 146 is Arg or Gln;
- Xaa at position 147 is Arg or Gln;
- Xaa at position 156 is His, Gly or Ser;
- Xaa at position 159 is Ser, Arg, Thr, Tyr, Val or Gly;
- Xaa at position 162 is Glu, Leu, Gly or Trp;
- Xaa at position 163 is Val, Gly, Arg or Ala;
- Xaa at position 169 is Arg, Ser, Leu, Arg or Cys;
- Xaa at position 170 is His, Arg or Ser;

wherein optionally 1–11 amino acids from the N-terminus and 1–5 from the C-terminus can be deleted; and wherein the N-terminus is joined to the C-terminus directly or through a linker capable of joining the N-terminus to the C-terminus and having new C- and N-termini at amino acids;

| | | |
|---|---|---|
| 38–39 | 62–63 | 123–124 |
| 39–40 | 63–64 | 124–125 |
| 40–41 | 64–65 | 125–126 |
| 41–42 | 65–66 | 126–127 |
| 42–43 | 66–67 | 128–129 |
| 43–44 | 67–68 | 128–129 |
| 45–46 | 68–69 | 129–130 |
| 48–49 | 69–70 | 130–131 |
| 49–50 | 70–71 | 131–132 |
| 52–53 | 71–72 | 132–133 |
| 53–54 | 91–92 | 133–134 |
| 54–55 | 92–93 | 134–135 |
| 55–56 | 93–94 | 135–136 |
| 56–57 | 94–95 | 136–137 |
| 57–58 | 95–96 | 137–138 |
| 58–59 | 96–97 | 138–139 |
| 59–60 | 97–98 | 139–140 |
| 60–61 | 98–99 | 140–141 |
| 61–62 | 99–100 | 141–142 |
| | | or |
| | | 142–143; |

(II) A polypeptide comprising; a modified hIL-3 amino acid sequence of the formula:

```
Ala Pro Met Thr Gln Thr Thr Ser Leu Lys Thr Ser Trp Val Asn       (SEQ ID NO:2)
1               5                   10                  15

Cys Xaa Xaa Xaa Xaa Xaa Xaa Xaa Xaa Xaa Xaa Xaa Xaa Xaa Xaa
                20                  25                  30

Xaa Xaa Xaa Xaa Xaa Xaa Xaa Xaa Asn Xaa Xaa Xaa Xaa Xaa Xaa
                35                  40                  45

Xaa Xaa Xaa Xaa Xaa Xaa Xaa Xaa Xaa Xaa Xaa Xaa Xaa Xaa Xaa
                50                  55                  60

Xaa Xaa Xaa Xaa Xaa Xaa Xaa Xaa Xaa Xaa Xaa Xaa Xaa Xaa Xaa
                65                  70                  75

Xaa Xaa Xaa Xaa Xaa Xaa Xaa Xaa Xaa Xaa Xaa Xaa Xaa Xaa Xaa
                80                  85                  90

Xaa Xaa Xaa Xaa Xaa Xaa Xaa Xaa Xaa Xaa Xaa Xaa Xaa Xaa Xaa
                95                  100                 105

Xaa Phe Xaa Xaa Xaa Xaa Xaa Xaa Xaa Xaa Xaa Xaa Xaa Xaa Xaa
                110                 115                 120

Xaa Xaa Xaa Gln Gln Thr Thr Leu Ser Leu Ala Ile Phe;
                125                 130
``` wherein Xaa at position 17 is Ser, Lys, Gly, Asp, Met, Gln, or Arg;

Xaa at position 18 is Asn, His, Leu, Ile, Phe, Arg, or Gln;

Xaa at position 19 is Met, Phe, Ile, Arg, Gly, Ala, or Cys;

Xaa at position 20 is Ile, Cys, Gln, Glu, Arg, Pro, or Ala;

Xaa at position 21 is Asp, Phe, Lys, Arg, Ala, Gly, Glu, Gln, Asn, Thr, Ser or Val;

Xaa at position 22 is Glu, Trp, Pro, Ser, Ala, His, Asp, Asn, Gln, Leu, Val or Gly;

Xaa at position 23 is Ile, Val, Ala, Gly, Trp, Lys, Phe, Leu, Ser, or Arg;

Xaa at position 24 is Ile, Gly, Val, Arg, Ser, Phe, or Leu;

Xaa at position 25 is Thr, His, Gly, Gln, Arg, Pro, or Ala;

Xaa at position 26 is His, Thr, Phe, Gly, Arg, Ala, or Trp;

Xaa at position 27 is Leu, Gly, Arg, Thr, Ser, or Ala;

Xaa at position 28 is Lys, Arg, Leu, Gln, Gly, Pro, Val or Trp;

Xaa at position 29 is Gln, Asn, Leu, Pro, Arg, or Val;

Xaa at position 30 is Pro, His, Thr, Gly, Asp, Gln, Ser, Leu, or Lys;

Xaa at position 31 is Pro, Asp, Gly, Ala, Arg, Leu, or Gln;

Xaa at position 32 is Leu, Val, Arg, Gln, Asn, Gly, Ala, or Glu;

Xaa at position 33 is Pro, Leu, Gln, Ala, Thr, or Glu;

Xaa at position 34 is Leu, Val, Gly, Ser, Lys, Glu, Gln, Thr, Arg, Ala, Phe, Ile or Met;

Xaa at position 35 is Leu, Ala, Gly, Asn, Pro, Gln, or Val;

Xaa at position 36 is Asp, Leu, or Val;

Xaa at position 37 is Phe, Ser, Pro, Trp, or Ile;

Xaa at position 38 is Asn, or Ala;

Xaa at position 40 is Leu, Trp, or Arg;

Xaa at position 41 is Asn, Cys, Arg, Leu, His, Met, or Pro;

Xaa at position 42 is Gly, Asp, Ser, Cys, Asn, Lys, Thr, Leu, Val, Glu, Phe, Tyr, Ile, Met or Ala;

Xaa at position 43 is Glu, Asn, Tyr, Leu, Phe, Asp, Ala, Cys, Gln, Arg, Thr, Gly or Ser;

Xaa at position 44 is Asp, Ser, Leu, Arg, Lys, Thr, Met, Trp, Glu, Asn, Gln, Ala or Pro;

Xaa at position 45 is Gln, Pro, Phe, Val, Met, Leu, Thr, Lys, Trp, Asp, Asn, Arg, Ser, Ala, Ile, Glu or His;

Xaa at position 46 is Asp, Phe, Ser, Thr, Cys, Glu, Asn, Gln, Lys, His, Ala, Tyr, Ile, Val or Gly;

Xaa at position 47 is Ile, Gly, Val, Ser, Arg, Pro, or His;

Xaa at position 48 is Leu, Ser, Cys, Arg, Ile, His, Phe, Glu, Lys, Thr, Ala, Met, Val or Asn;

Xaa at position 49 is Met, Arg, Ala, Gly, Pro, Asn, His, or Asp;

Xaa at position 50 is Glu, Leu, Thr, Asp, Tyr, Lys, Asn, Ser, Ala, Ile, Val, His, Phe, Met or Gln;

Xaa at position 51 is Asn, Arg, Met, Pro, Ser, Thr, or His;

Xaa at position 52 is Asn, His, Arg, Leu, Gly, Ser, or Thr;

Xaa at position 53 is Leu, Thr, Ala, Gly, Glu, Pro, Lys, Ser, or Met;

Xaa at position 54 is Arg, Asp, Ile, Ser, Val, Thr, Gln, Asn, Lys, His, Ala or Leu;

Xaa at position 55 is Arg, Thr, Val, Ser, Leu, or Gly;

Xaa at position 56 is Pro, Gly, Cys, Ser, Gln, Glu, Arg, His, Thr, Ala, Tyr, Phe, Leu, Val or Lys;

Xaa at position 57 is Asn or Gly;

Xaa at position 58 is Leu, Ser, Asp, Arg, Gln, Val, or Cys;

Xaa at position 59 is Glu Tyr, His, Leu, Pro, or Arg;

Xaa at position 60 is Ala, Ser, Pro, Tyr, Asn, or Thr;

Xaa at position 61 is Phe, Asn, Glu, Pro, Lys, Arg, or Ser;

Xaa at position 62 is Asn, His, Val, Arg, Pro, Thr, Asp, or Ile;

Xaa at position 63 is Arg, Tyr, Trp, Lys, Ser, His, Pro, or Val;

Xaa at position 64 is Ala, Asn, Pro, Ser, or Lys;

Xaa at position 65 is Val, Thr, Pro, His, Leu, Phe, or Ser;

Xaa at position 66 is Lys, Ile, Arg, Val, Asn, Glu, or Ser;

Xaa at position 67 is Ser, Ala, Phe, Val, Gly, Asn, Ile, Pro, or His;

Xaa at position 68 is Leu, Val, Trp, Ser, Ile, Phe, Thr, or His;

Xaa at position 69 is Gln, Ala, Pro, Thr, Glu, Arg, Trp, Gly, or Leu;

Xaa at position 70 is Asn, Leu, Val, Trp, Pro, or Ala;

Xaa at position 71 is Ala, Met, Leu, Pro, Arg, Glu, Thr, Gln, Trp, or Asn;

Xaa at position 72 is Ser, Glu, Met, Ala, His, Asn, Arg, or Asp;

Xaa at position 73 is Ala, Glu, Asp, Leu, Ser, Gly, Thr, or Arg;

Xaa at position 74 is Ile, Met, Thr, Pro, Arg, Gly, Ala;

Xaa at position 75 is Glu, Lys, Gly, Asp, Pro, Trp, Arg, Ser, Gln, or Leu;

Xaa at position 76 is Ser, Val, Ala, Asn, Trp, Glu, Pro, Gly, or Asp;

Xaa at position 77 is Ile, Ser, Arg, Thr, or Leu;

Xaa at position 78 is Leu, Ala, Ser, Glu, Phe, Gly, or Arg;

Xaa at position 79 is Lys, Thr, Asn, Met, Arg, Ile, Gly, or Asp;

Xaa at position 80 is Asn, Trp, Val, Gly, Thr, Leu, Glu, or Arg;

Xaa at position 81 is Leu, Gln, Gly, Ala, Trp, Arg, Val, or Lys;

Xaa at position 82 is Leu, Gln, Lys, Trp, Arg, Asp, Glu, Asn, His, Thr, Ser. Ala, Tyr, Phe, Ile, Met or Val;

Xaa at position 83 is Pro, Ala, Thr, Trp, Arg, or Met;

Xaa at position 84 is Cys, Glu, Gly, Arg, Met, or Val;

Xaa at position 85 is Leu, Asn, Val, or Gln;

Xaa at position 86 is Pro, Cys, Arg, Ala, or Lys;

Xaa at position 87 is Leu, Ser, Trp, or Gly;

Xaa at position 88 is Ala, Lys, Arg, Val, or Trp;

Xaa at position 89 is Thr, Asp, Cys, Leu, Val, Glu, His, Asn, or Ser;

Xaa at position 90 is Ala, Pro, Ser, Thr, Gly, Asp, Ile, or Met;

Xaa at position 91 is Ala, Pro, Ser, Thr, Phe, Leu, Asp, or His;

Xaa at position 92 is Pro, Phe, Arg, Ser, Lys, His, Ala, Gly, Ile or Leu;

Xaa at position 93 is Thr, Asp, Ser, Asn, Pro, Ala, Leu, or Arg;

Xaa at position 94 is Arg, Ile, Ser, Glu, Leu, Val, Gln, Lys, His, Ala, or Pro;

Xaa at position 95 is His, Gln, Pro, Arg, Val, Leu, Gly, Thr, Asn, Lys, Ser, Ala, Trp, Phe, Ile, or Tyr;

Xaa at position 96 is Pro, Lys, Tyr, Gly, Ile, or Thr;

Xaa at position 97 is Ile, Val, Lys, Ala, or Asn;

Xaa at position 98 is His, Ile, Asn, Leu, Asp, Ala, Thr, Glu, Gln, Ser, Phe, Met, Val, Lys, Arg, Tyr or Pro;

Xaa at position 99 is Ile, Leu, Arg, Asp, Val, Pro, Gln, Gly, Ser, Phe, or His;

Xaa at position 100 is Lys, Tyr, Leu, His, Arg, Ile, Ser, Gln, or Pro;

Xaa at position 101 is Asp, Pro, Met, Lys, His, Thr, Val, Tyr, Glu, Asn, Ser, Ala, Gly, Ile, Leu, or Gln;

Xaa at position 102 is Gly, Leu, Glu, Lys, Ser, Tyr, or Pro;

Xaa at position 103 is Asp, or Ser;

Xaa at position 104 is Trp, Val, Cys, Tyr, Thr, Met, Pro, Leu, Gln, Lys, Ala, Phe, or Gly;

Xaa at position 105 is Asn, Pro, Ala, Phe, Ser, Trp, Gln, Tyr, Leu, Lys, Ile, Asp, or His;

Xaa at position 106 is Glu, Ser, Ala, Lys, Thr, Ile, Gly, or Pro;

Xaa at position 108 is Arg, Lys, Asp, Leu, Thr, Ile, Gln, His, Ser, Ala or Pro;

Xaa at position 109 is Arg, Thr, Pro, Glu, Tyr, Leu, Ser, or Gly;

Xaa at position 110 is Lys, Ala, Asn, Thr, Leu, Arg, Gln, His, Glu, Ser, or Trp;

Xaa at position 111 is Leu, Ile, Arg, Asp, or Met;

Xaa at position 112 is Thr, Val, Gln, Tyr, Glu, His, Ser, or Phe;

Xaa at position 113 is Phe, Ser, Cys, His, Gly, Trp, Tyr, Asp, Lys, Leu, Ile, Val or Asn;

Xaa at position 114 is Tyr, Cys, His, Ser, Trp, Arg, or Leu;

Xaa at position 115 is Leu, Asn, Val, Pro, Arg, Ala, His, Thr, Trp, or Met;

Xaa at position 116 is Lys, Leu, Pro, Thr, Met, Asp, Val, Glu, Arg, Trp, Ser, Asn, His, Ala, Tyr, Phe, Gln, or Ile;

Xaa at position 117 is Thr, Ser, Asn, Ile, Trp, Lys, or Pro;

Xaa at position 118 is Leu, Ser, Pro, Ala, Glu, Cys, Asp, or Tyr;

Xaa at position 119 is Glu, Ser, Lys, Pro, Leu, Thr, Tyr, or Arg;

Xaa at position 120 is Asn, Ala, Pro, Leu, His, Val, or Gln;

Xaa at position 121 is Ala, Ser, Ile, Asn, Pro, Lys, Asp, or Gly;

Xaa at position 122 is Gln, Ser, Met, Trp, Arg, Phe, Pro, His, Ile, Tyr, or Cys;

Xaa at position 123 is Ala, Met, Glu, His, Ser, Pro, Tyr, or Leu;

wherein optionally from 1 to 14 amino acids can be deleted from the N-terminus and/or from 1 to 15 amino acids can be deleted from the C-terminus; and wherein from 0 to 44 of the amino acids designated by Xaa are different from the corresponding amino acids of native (1–133) human interleukin-3; and wherein the N-terminus is joined to the C-terminus directly or through a linker (L2) capable of joining the N-terminus to the C-terminus and having new C- and N-termini at amino acids;

| | | |
|---|---|---|
| 26–27 | 49–50 | 83–84 |
| 27–28 | 50–51 | 84–85 |
| 28–29 | 51–52 | 85–86 |
| 29–30 | 52–53 | 86–87 |
| 30–31 | 53–54 | 87–88 |
| 31–32 | 54–55 | 88–89 |
| 32–33 | 64–65 | 89–90 |
| 33–34 | 65–66 | 90–91 |
| 34–35 | 66–67 | 91–92 |
| 35–36 | 67–68 | 92–93 |
| 36–37 | 68–69 | 97–98 |
| 37–38 | 69–70 | 98–99 |
| 38–39 | 70–71 | 99–100 |
| 39–40 | 71–72 | 100–101 |
| 40–41 | 72–73 | 101–102 |
| 41–42 | 82–83 | 102–103 or 103–104; | or (III) A polypeptide comprising; a modified human c-mpl ligand amino acid sequence of the formula:

```
SerProAlaProProAlaCysAspLeuArgValLeuSerLysLeuLeuArgAspSer  (SEQ ID NO:3)
1             5              10             15

HisValLeuHisSerArgLeuSerGlnCysProGluValHisProLeuProThrPro
20            25             30             35

ValLeuLeuProAlaValAspPheSerLeuGlyGluTrpLysThrGlnMetGluGlu
     40             45             50             55

ThrLysAlaGlnAspIleLeuGlyAlaValThrLeuLeuLeuGluGlyValMetAla
     60             65             70             75

AlaArgGlyGlnLeuGlyProThrCysLeuSerSerLeuLeuGlyGlnLeuSerGly
         80             85             90             95

GlnValArgLeuLeuLeuGlyAlaLeuGlnserLeuLeuGlyThrGlnXaaXaaXaa
            100            105            110

XaaGlyArgThrThrAlaHisLysAspProAsnAlaIlePheLeuSerPheGlnHis
115            120            125            130

LeuLeuArgGlyLysValArgPheLeuMetLeuValGlyGlySerThrLeuCysVal
     135            140            145            150

ArgArgAlaProProThrThrAlaValProSerArgThrSerLeuValLeuThrLeu
       155            160            165            170

AsnGluLeuProAsnArgThrSerGlyLeuLeuGluThrAsnPheThrAlaSerAla
         175            180            185            190

ArgThrThrGlySerGlyLeuLeuLysTrpGlnGlnGlyPheArgAlaLysIlePro
            195            200            205

GlyLeuLeuAsnGlnThrSerArgSerLeuAspGlnIleProGlyTyrLeuAsnArg
210            215            220            225

IleHisGluLeuLeuAsnGlyThrArgGlyLeuPheProGlyProSerArgArgThr
    230            235            240            245

LeuGlyAlaProAspIleSerSerGlyThrSerAspThrGlySerLeuProProAsn
      250            255            260            265

LeuGlnProGlyTyrSerProSerProThrHisProProThrGlyGlnTyrThrLeu
         270            275            280            285

PheProLeuProProThrLeuProThrProValValGlnLeuHisProLeuLeuPro
            290            295            300

AspProSerAlaProThrProThrProThrSerProLeuLeuAsnThrSerTyrThr
305            310            315            320

HisSerGlnAsnLeuSerGlnGluGly
    325            330  332
``` wherein;

Xaa at position 112 is deleted or Leu, Ala, Val, Ile, Pro, Phe, Trp, or Met;

Xaa at position 113 is deleted or Pro, Phe, Ala, Val, Leu, Ile, Trp, or Met;

Xaa at position 114 is deleted or Pro, Phe, Ala, Val, Leu, Ile, Trp, or Met;

Xaa at position 115 is deleted or Gln, Gly, Ser, Thr, Tyr, or Asn; and wherein the N-terminus is joined to the C-terminus directly or through a linker (L2) capable of joining the N-terminus to the C-terminus and having new C- and N-termini at amino acids;

| | | |
|---|---|---|
| 26–27 | 51–52 | 108–109 |
| 27–28 | 52–53 | 109–110 |
| 28–29 | 53–54 | 110–111 |
| 29–30 | 54–55 | 111–112 |
| 30–31 | 55–56 | 112–113 |
| 32–33 | 56–57 | 113–114 |
| 33–34 | 57–58 | 114–115 |
| 34–35 | 58–59 | 115–116 |
| 36–37 | 59–60 | 116–117 |
| 37–38 | 78–79 | 117–118 |
| 38–39 | 79–80 | 118–119 |
| 40–41 | 80–81 | 119–120 |
| 41–42 | 81–82 | 120–121 |
| 42–43 | 82–83 | 121–122 |
| 43–44 | 83–84 | 122–123 |
| 44–45 | 84–85 | 123–124 |
| 46–47 | 85–86 | 124–125 |
| 47–48 | 86–87 | 125–126 |
| 48–49 | 87–88 | 126–127 |

-continued

| 50–51 | 88–89 | or 127–128; |
|---|---|---| or (IV) A polypeptide comprising; a modified hIL-3 amino acid sequence of the formula: Thr Thr Ser Leu Lys Thr Ser Trp Val Asn

```
Ala Pro Met Thr Gln Thr Thr Ser Leu Lys Thr Ser Trp Val Asn (SEQ ID NO:2)
1           5                   10                      15

Cys Xaa Xaa Xaa Xaa Xaa Xaa Xaa Xaa Xaa Xaa Xaa Xaa Xaa
            20                  25                      30

Xaa Xaa Xaa Xaa Xaa Xaa Xaa Asn Xaa Xaa Xaa Xaa Xaa Xaa
            35                  40                      45

Xaa Xaa Xaa Xaa Xaa Xaa Xaa Xaa Xaa Xaa Xaa Xaa Xaa Xaa
            50                  55                      60

Xaa Xaa Xaa Xaa Xaa Xaa Xaa Xaa Xaa Xaa Xaa Xaa Xaa Xaa
            65                  70                      75

Xaa Xaa Xaa Xaa Xaa Xaa Xaa Xaa Xaa Xaa Xaa Xaa Xaa Xaa
            80                  85                      90

Xaa Xaa Xaa Xaa Xaa Xaa Xaa Xaa Xaa Xaa Xaa Xaa Xaa Xaa
            95                  100                     105

Xaa Phe Xaa Xaa Xaa Xaa Xaa Xaa Xaa Xaa Xaa Xaa Xaa Xaa
            110                 115                     120

Xaa Xaa Xaa Gln Gln Thr Thr Leu Ser Leu Ala Ile Phe
            125                 130
``` wherein Xaa at position 17 is Ser, Lys, Gly, Asp, Met, Gln, or Arg;

Xaa at position 18 is Asn, His, Leu, Ile, Phe, Arg, or Gln;

Xaa at position 19 is Met, Phe, Ile, Arg, Gly, Ala, or Cys;

Xaa at position 20 is Ile, Cys, Gln, Glu, Arg, Pro, or Ala;

Xaa at position 21 is Asp, Phe, Lys, Arg, Ala, Gly, Glu, Gln, Asn, Thr, Ser or Val;

Xaa at position 22 is Glu, Trp, Pro, Ser, Ala, His, Asp, Asn, Gln, Leu, Val or Gly;

Xaa at position 23 is Ile, Val, Ala, Gly, Trp, Lys, Phe, Leu, Ser, or Arg;

Xaa at position 24 is Ile, Gly, Val, Arg, Ser, Phe, or Leu;

Xaa at position 25 is Thr, His, Gly, Gln, Arg, Pro, or Ala;

Xaa at position 26 is His, Thr, Phe, Gly, Arg, Ala, or Trp;

Xaa at position 27 is Leu, Gly, Arg, Thr, Ser, or Ala;

Xaa at position 28 is Lys, Arg, Leu, Gln, Gly, Pro, Val or Trp;

Xaa at position 29 is Gln, Asn, Leu, Pro, Arg, or Val;

Xaa at position 30 is Pro, His, Thr, Gly, Asp, Gln, Ser, Leu, or Lys;

Xaa at position 31 is Pro, Asp, Gly, Ala, Arg, Leu, or Gln;

Xaa at position 32 is Leu, Val, Arg, Gln, Asn, Gly, Ala, or Glu;

Xaa at position 33 is Pro, Leu, Gln, Ala, Thr, or Glu;

Xaa at position 34 is Leu, Val, Gly, Ser, Lys, Glu, Gln, Thr, Arg, Ala, Phe, Ile or Met;

Xaa at position 35 is Leu, Ala, Gly, Asn, Pro, Gln, or Val;

Xaa at position 36 is Asp, Leu, or Val;

Xaa at position 37 is Phe, Ser, Pro, Trp, or Ile;

Xaa at position 38 is Asn, or Ala;

Xaa at position 40 is Leu, Trp, or Arg;

Xaa at position 41 is Asn, Cys, Arg, Leu, His, Met, or Pro;

Xaa at position 42 is Gly, Asp, Ser, Cys, Asn, Lys, Thr, Leu, Val, Glu, Phe, Tyr, Ile, Met or Ala;

Xaa at position 43 is Glu, Asn, Tyr, Leu, Phe, Asp, Ala, Cys, Gln, Arg, Thr, Gly or Ser;

Xaa at position 44 is Asp, Ser, Leu, Arg, Lys, Thr, Met, Trp, Glu, Asn, Gln, Ala or Pro;

Xaa at position 45 is Gln, Pro, Phe, Val, Met, Leu, Thr, Lys, Trp, Asp, Asn, Arg, Ser, Ala, Ile, Glu or His;

Xaa at position 46 is Asp, Phe, Ser, Thr, Cys, Glu, Asn, Gln, Lys, His, Ala, Tyr, Ile, Val or Gly;

Xaa at position 47 is Ile, Gly, Val, Ser, Arg, Pro, or His;

Xaa at position 48 is Leu, Ser, Cys, Arg, Ile, His, Phe, Glu, Lys, Thr, Ala, Met, Val or Asn;

Xaa at position 49 is Met, Arg, Ala, Gly, Pro, Asn, His, or Asp;

Xaa at position 50 is Glu, Leu, Thr, Asp, Tyr, Lys, Asn, Ser, Ala, Ile, Val, His, Phe, Met or Gln;

Xaa at position 51 is Asn, Arg, Met, Pro, Ser, Thr, or His;

Xaa at position 52 is Asn, His, Arg, Leu, Gly, Ser, or Thr;

Xaa at position 53 is Leu, Thr, Ala, Gly, Glu, Pro, Lys, Ser, or

Xaa at position 54 is Arg, Asp, Ile, Ser, Val, Thr, Gln, Asn, Lys, His, Ala or Leu;

Xaa at position 55 is Arg, Thr, Val, Ser, Leu, or Gly;

Xaa at position 56 is Pro, Gly, Cys, Ser, Gln, Glu, Arg, His, Thr, Ala, Tyr, Phe, Leu, Val or Lys;

Xaa at position 57 is Asn or Gly;

Xaa at position 58 is Leu, Ser, Asp, Arg, Gln, Val, or Cys;

Xaa at position 59 is Glu Tyr, His, Leu, Pro, or Arg;

Xaa at position 60 is Ala, Ser, Pro, Tyr, Asn, or Thr;

Xaa at position 61 is Phe, Asn, Glu, Pro, Lys, Arg, or Ser;

Xaa at position 62 is Asn, His, Val, Arg, Pro, Thr, Asp, or Ile;

Xaa at position 63 is Arg, Tyr, Trp, Lys, Ser, His, Pro, or Val;

Xaa at position 64 is Ala, Asn, Pro, Ser, or Lys;
Xaa at position 65 is Val, Thr, Pro, His, Leu, Phe, or Ser;
Xaa at position 66 is Lys, Ile, Arg, Val, Asn, Glu, or Ser;
Xaa at position 67 is Ser, Ala, Phe, Val, Gly, Asn, Ile, Pro, or His;
Xaa at position 68 is Leu, Val, Trp, Ser, Ile, Phe, Thr, or His;
Xaa at position 69 is Gln, Ala, Pro, Thr, Glu, Arg, Trp, Gly, or Leu;
Xaa at position 70 is Asn, Leu, Val, Trp, Pro, or Ala;
Xaa at position 71 is Ala, Met, Leu, Pro, Arg, Glu, Thr, Gln, Trp, or Asn;
Xaa at position 72 is Ser, Glu, Met, Ala, His, Asn, Arg, or Asp;
Xaa at position 73 is Ala, Glu, Asp, Leu, Ser, Gly, Thr, or Arg;
Xaa at position 74 is Ile, Met, Thr, Pro, Arg, Gly, Ala;
Xaa at position 75 is Glu, Lys, Gly, Asp, Pro, Trp, Arg, Ser, Gln, or Leu;
Xaa at position 76 is Ser, Val, Ala, Asn, Trp, Glu, Pro, Gly, or Asp;
Xaa at position 77 is Ile, Ser, Arg, Thr, or Leu;
Xaa at position 78 is Leu, Ala, Ser, Glu, Phe, Gly, or Arg;
Xaa at position 79 is Lys, Thr, Asn, Met, Arg, Ile, Gly, or Asp;
Xaa at position 80 is Asn, Trp, Val, Gly, Thr, Leu, Glu, or Arg;
Xaa at position 81 is Leu, Gln, Gly, Ala, Trp, Arg, Val, or Lys;
Xaa at position 82 is Leu, Gln, Lys, Trp, Arg, Asp, Glu, Asn, His, Thr, Ser, Ala, Tyr, Phe, Ile, Met or Val;
Xaa at position 83 is Pro, Ala, Thr, Trp, Arg, or Met;
Xaa at position 84 is Cys, Glu, Gly, Arg, Met, or Val;
Xaa at position 85 is Leu, Asn, Val, or Gln;
Xaa at position 86 is Pro, Cys, Arg, Ala, or Lys;
Xaa at position 87 is Leu, Ser, Trp, or Gly;
Xaa at position 88 is Ala, Lys, Arg, Val, or Trp;
Xaa at position 89 is Thr, Asp, Cys, Leu, Val, Glu, His, Asn, or Ser;
Xaa at position 90 is Ala, Pro, Ser, Thr, Gly, Asp, Ile, or Met;
Xaa at position 91 is Ala, Pro, Ser, Thr, Phe, Leu, Asp, or His;
Xaa at position 92 is Pro, Phe, Arg, Ser, Lys, His, Ala, Gly, Ile or Leu;
Xaa at position 93 is Thr, Asp, Ser, Asn, Pro, Ala, Leu, or Arg;
Xaa at position 94 is Arg, Ile, Ser, Glu, Leu, Val, Gln, Lys, His, Ala, or Pro;
Xaa at position 95 is His, Gln, Pro, Arg, Val, Leu, Gly, Thr, Asn, Lys, Ser, Ala, Trp, Phe, Ile, or Tyr;
Xaa at position 96 is Pro, Lys, Tyr, Gly, Ile, or Thr;
Xaa at position 97 is Ile, Val, Lys, Ala, or Asn;
Xaa at position 98 is His, Ile, Asn, Leu, Asp, Ala, Thr, Glu, Gln, Ser, Phe, Met, Val, Lys, Arg, Tyr or Pro;
Xaa at position 99 is Ile, Leu, Arg, Asp, Val, Pro, Gln, Gly, Ser, Phe, or His;
Xaa at position 100 is Lys, Tyr, Leu, His, Arg, Ile, Ser, Gln, or Pro;
Xaa at position 101 is Asp, Pro, Met, Lys, His, Thr, Val, Tyr, Glu, Asn, Ser, Ala, Gly, Ile, Leu, or Gln;
Xaa at position 102 is Gly, Leu, Glu, Lys, Ser, Tyr, or Pro;
Xaa at position 103 is Asp, or Ser;
Xaa at position 104 is Trp, Val, Cys, Tyr, Thr, Met, Pro, Leu, Gln, Lys, Ala, Phe, or Gly;
Xaa at position 105 is Asn, Pro, Ala, Phe, Ser, Trp, Gln, Tyr, Leu, Lys, Ile, Asp, or His;
Xaa at position 106 is Glu, Ser, Ala, Lys, Thr, Ile, Gly, or Pro;
Xaa at position 108 is Arg, Lys, Asp, Leu, Thr, Ile, Gln, His, Ser, Ala or Pro;
Xaa at position 109 is Arg, Thr, Pro, Glu, Tyr, Leu, Ser, or Gly;
Xaa at position 110 is Lys, Ala, Asn, Thr, Leu, Arg, Gln, His, Glu, Ser, or Trp;
Xaa at position 111 is Leu, Ile, Arg, Asp, or Met;
Xaa at position 112 is Thr, Val, Gln, Tyr, Glu, His, Ser, or Phe;
Xaa at position 113 is Phe, Ser, Cys, His, Gly, Trp, Tyr, Asp, Lys, Leu, Ile, Val or Asn;
Xaa at position 114 is Tyr, Cys, His, Ser, Trp, Arg, or Leu;
Xaa at position 115 is Leu, Asn, Val, Pro, Arg, Ala, His, Thr, Trp, or Met;
Xaa at position 116 is Lys, Leu, Pro, Thr, Met, Asp, Val, Glu, Arg, Trp, Ser, Asn, His, Ala, Tyr, Phe, Gin, or Ile;
Xaa at position 117 is Thr, Ser, Asn, Ile, Trp, Lys, or Pro;
Xaa at position 118 is Leu, Ser, Pro, Ala, Glu, Cys, Asp, or Tyr;
Xaa at position 119 is Glu, Ser, Lys, Pro, Leu, Thr, Tyr, or Arg;
Xaa at position 120 is Asn, Ala, Pro, Leu, His, Val, or Gln;
Xaa at position 121 is Ala, Ser, Ile, Asn, Pro, Lys, Asp, or Gly;
Xaa at position 122 is Gln, Ser, Met, Trp, Arg, Phe, Pro, His, Ile, Tyr, or Cys;
Xaa at position 123 is Ala, Met, Glu, His, Ser, Pro, Tyr, or Leu;
wherein optionally from 1 to 14 amino acids can be deleted from the N-terminus and/or from 1 to 15 amino acids can be deleted from the C-terminus; and wherein from 1 to 44 of the amino acids designated by Xaa are different from the corresponding amino acids of native (1–133) human interleukin-3;
or
(V) a colony stimulating factor;
and wherein $L_1$ is a linker capable of linking $R_1$ to $R_2$;
with the proviso that at least $R_1$ or $R_2$ is selected from the polypeptide of formula (I), (II), or (III); and
said hematopoietic protein can optionally be immediately preceded by (methionine$^{-1}$), (alanine$^{-1}$) or (methionine$^{-2}$, alanine$^{-1}$).

The more preferred breakpoints at which new C-terminus and N-terminus can be made in the polypeptide (I) above are; 38–39, 39–40, 40–41, 41–42, 48–49, 53–54, 54–55, 55–56, 56–57, 57–58, 58–59, 59–60, 60–61, 61–62, 62–63, 64–65, 65–66, 66–67, 67–68, 68–69, 69–70, 96–97, 125–126, 126–127, 127–128, 128–129, 129–130, 130–131, 131–132, 132–133, 133–134, 134–135, 135–136, 136–137, 137–138, 138–139, 139–140, 140–141 and 141–142.

The most preferred breakpoints at which new C-terminus and N-terminus can be made in the polypeptide (I) above are; 38–39, 48–49, 96–97, 125–126, 132–133 and 141–142.

The more preferred breakpoints at which new C-terminus and N-terminus can be made in the polypeptide (II) above are; 28–29, 29–30, 30–31, 31–32, 32–33, 33–34, 34–35, 35–36, 36–37, 37–38, 38–39, 39–40, 66–67, 67–68, 68–69, 69–70, 70–71, 84–85, 85–86, 86–87, 87–88, 88–89, 89–90, 90–91, 98–99, 99–100, 100–101 and 101–102.

The most preferred breakpoints at which new C-terminus and N-terminus can be made in the polypeptide (II) above are; 34–35, 69–70 and 90–91.

The more preferred breakpoints at which new C-terminus and N-terminus can be made in the polypeptide (III) above or the amino acid sequence of (SEQ ID NO:256) are; 80–81, 81–82, 82–83, 83–84, 84–85, 85–86, 86–87, 108–109, 109–110, 110–111, 111–112, 112–113, 113–114, 114–115, 115–116, 116–117, 117–118, 118–119, 119–120, 120–121, 121–122, 122–123, 123–124, 124–125, 125–126 and 126–127.

The most preferred breakpoints at which new C-terminus and N-terminus can be made in the polypeptide (III) above or the amino acid sequence of (SEQ ID NO:256) are; 81–82, 108–109, 115–116, 119–120, 122–123 and 125–126.

The invention is also intended to include multifunctional receptor agonist which comprises a sequence rearranged c-mpl receptor agonist in which the cysteine at position 7 and/or 151 are substituted with another amino acid. Preferably, the substitution at position 7 and 151 is Ser, Ala, Gly, His, Asn, Asp, Thr, Phe or Thr. More preferably, the substitution at position 7 and 151 is Ser, Ala, Gly, His or Asn.

The multifunctional receptor agonist of the present invention can also be represented by the following formula:

$(T^1)_a\text{-}(L^1)_b\text{-}X^1\text{-}(L)_c\text{-}X^2\text{-}(L^2)_d\text{-}(T^2)_e$

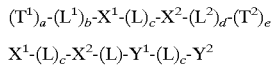

in which:
X$^1$ is a peptide comprising an amino acid sequence corresponding to the sequence of residues n'through J of the original protein having amino acids residues numbered sequentially 1 through J with an amino terminus at residue 1;

L is an optional linker;

X$^2$ is a peptide comprising an amino acid sequence of residues 1 through n of the original protein;

Y$^1$ is a peptide comprising an amino acid sequence corresponding to the sequence of residues n=1 through K of the original protein having amino acids residues numbered sequentially 1 through K with an amino terminus at residue 1;

Y$^2$ is a peptide comprising an amino acid sequence of residues 1 through n of the original protein;

L$^1$ and L$^2$ are optional peptide spacers:

n is an integer ranging from 1 to J–1;

b, c, and d are each independently 0 or 1;

a and e are either 0 or 1, provided that both a and e cannot both be 0; and

T$^1$ and T$^2$ are proteins.

Additionally, the present invention relates to recombinant expression vectors comprising nucleotide sequences encoding the multi-functional hematopoietic receptor agonists, related microbial expression systems, and processes for making the multi-functional hematopoietic receptor agonists. The invention also relates to pharmaceutical compositions containing the multi-functional hematopoietic receptor agonists, and methods for using the multi-functional hematopoietic receptor agonists.

In addition to the use of the multi-functional hematopoietic receptor agonists of the present invention in vivo, it is envisioned that in vitro uses would include the ability to stimulate bone marrow and blood cell activation and growth before infusion into patients.

BRIEF DESCRIPTION OF THE FIGURES

FIG. 4 shows a schematic of Method III, for creating new proteins in which the original N-terminus and C-terminus of the native protein are joined with a linker and different N-terminus and C-terminus of the protein are created. In the example shown the sequence rearrangement results in a new gene encoding a protein with a new N-terminus created at amino acid 97 of the original protein, the original C-terminus (a.a. 174) joined to amino acid 1 through a linker region and a new C-terminus created at amino acid 96 of the original sequence.

DETAILED DESCRIPTION OF THE INVENTION

Figure 1:
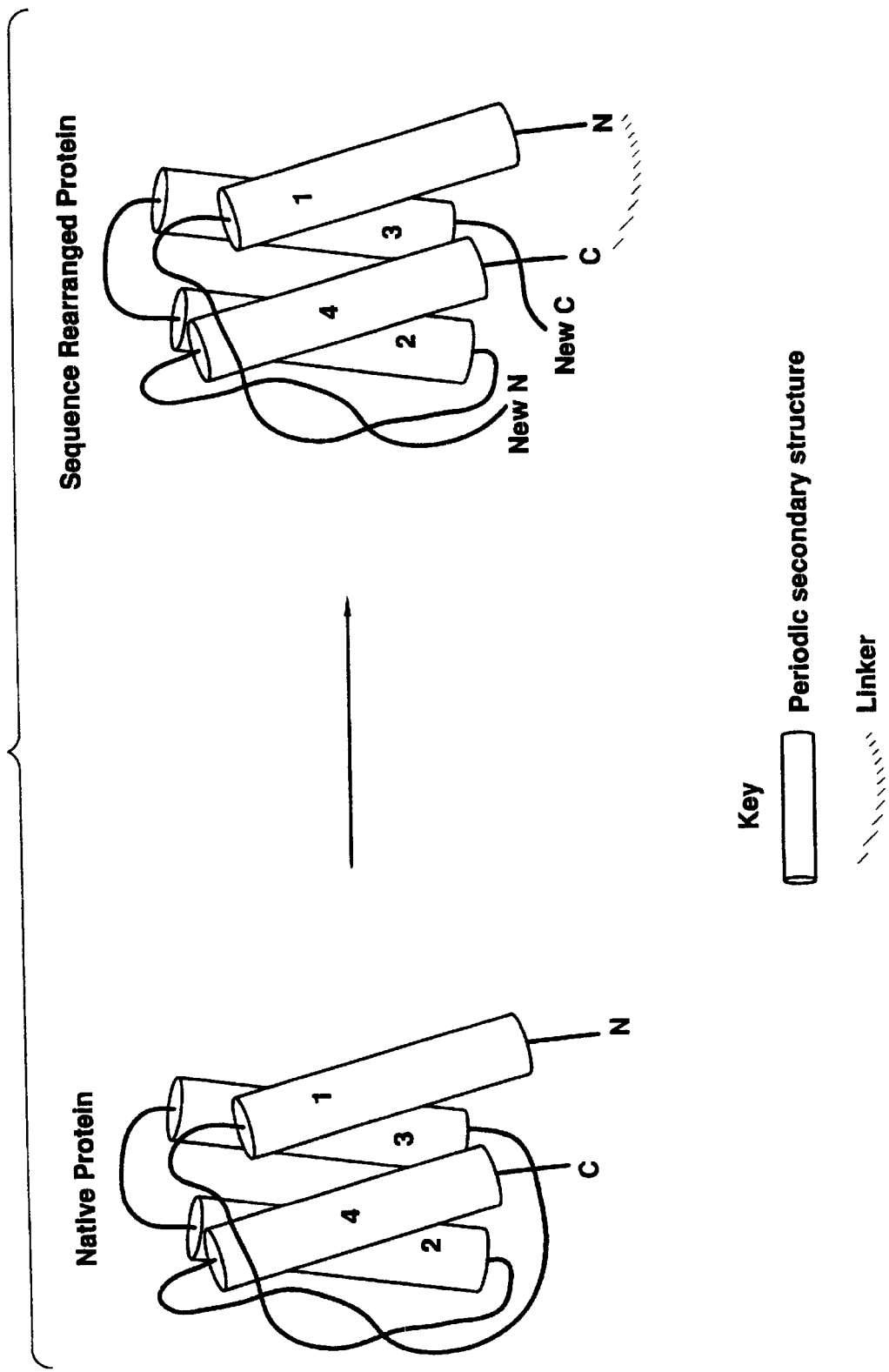
FIG. 1 schematically illustrates the sequence rearrangement of a protein. The N-terminus (N) and the C-terminus (C) of the native protein are joined through a linker, or joined directly. The protein is opened at a breakpoint creating a new N-terminus (new N) and a new C-terminus (new-C) resulting in a protein with a new linear amino acid sequence. A rearranged molecule may be synthesized de novo as linear molecule and not go through the steps of joining the original N-terminus and the C-terminus and opening of the protein at the breakpoint.

The present invention encompasses multi-functional hematopoietic receptor agonists formed from covalently linked polypeptides, each of which may act through a different and specific cell receptor to initiate complementary biological activities. Hematopoiesis requires a complex series of cellular events in which stem cells generate continuously into large populations of maturing cells in all major lineages. There are currently at least 20 known regulators with hematopoietic proliferative activity. Most of these proliferative regulators can only stimulate one or another type of colony formation in vitro, the precise pattern of colony formation stimulated by each regulator is quite distinctive. No two regulators stimulate exactly the same pattern of colony formation, as evaluated by colony numbers or, more importantly, by the lineage and maturation pattern of the cells making up the developing colonies. Proliferative responses can most readily be analyzed in simplified in vitro culture systems. Three quite different parameters can be distinguished: alteration in colony size, alteration in colony numbers and cell lineage. Two or more factors may act on the progenitor cell, inducing the formation of larger number of progeny thereby increasing the colony size. Two or more factors may allow increased number of progenitor cells to proliferate either because distinct subsets of progenitors cells exist that respond exclusively to one factor or because some progenitors require stimulation by two or more factors before being able to respond. Activation of additional receptors on a cell by the use of two or more factors is likely to enhance the mitotic signal because of coalescence of initially differing signal pathways into a common final pathway reaching the nucleus (Metcalf, Nature 339:27, 1989). Other mechanisms could explain synergy. For example, if one signaling pathway is limited by an intermediate activation of an additional signaling pathway which is caused by a second factor, then this may result in a super additive response. In some cases, activation of one receptor type can induce an enhanced expression of other receptors (Metcalf, Blood 82:3515–3523, 1993). Two or more factors may result in a different pattern of cell lineages than from a single factor. The use of multi-functional hematopoietic receptor agonists may have a potential clinical advantage resulting from a proliferative response that is not possible by any single factor.

The receptors of hematopoietic and other growth factors can be grouped into two distinct families of related proteins: (1) tyrosine kinase receptors, including those for epidermal growth factor, M-CSF (Sherr, Blood 75:1, 1990) and SCF (Yarden et al., EMBO J. 6:3341, 1987): and (2) hematopoietic receptors, not containing a tyrosine kinase domain, but exhibiting obvious homology in their extracellular domain (Bazan, PNAS USA 87:6934–6938, 1990). Included in this latter group are erythropoietin (EPO) (D'Andrea et al., Cell 57:277, 1989), GM-CSF (Gearing et al., EMBO J. 8:3667, 1989), IL-3 (Kitamura et al., Cell 66:1165, 1991), G-CSF (Fukunaga et al., J. Bio. Chem. 265:14008–15, 1990), IL-4 (Harada et al., PNAS USA 87:857, 1990), IL-5 (Takaki et al., EMBO J. 9:4367, 1990), IL-6 (Yamasaki et al., Science 241:825, 1988), IL-7 (Goodwin et al., Cell 60:941–51, 1990), LIF (Gearing et al., EMBO J. 10:2839, 1991) and IL-2 (Cosman et al., Mol-Immunol. 23: 935–94, 1986). Most of the latter group of receptors exists in a high-affinity form as heterodimers. After ligand binding, the specific α-chains become associated with at least one other receptor chain (β-chain, γ-chain). Many of these factors share a common receptor subunit. The α-chains for GM-CSF, IL-3 and IL-5 share the same β-chain (Kitamura et al., Cell 66:1165, 1991), Takaki et al., EMBO J. 10:2833–8, 1991) and receptor complexes for IL-6, LIF and IL-11 share a common β-chain (gp130) (Taga et al., Cell 58:573–81, 1989; Gearing et al., Science 255:1434–7, 1992). The receptor complexes of IL-2, IL-4, IL-7, IL-9 and IL-15 share a common γ-chain (Kondo et al., Science 262:1874, 1993; Russell et al., Science 266: 1042–1045, 1993; Noguchi et al., Science 262:1877, 1993; Giri et al., EMBO J. 13:2822–2830, 1994).

The use of a multiply acting hematopoietic factor may also have a potential advantage by reducing the demands placed on factor-producing cells and their induction systems. If there are limitations in the ability of a cell to produce a factor, then by lowering the required concentrations of each of the factors, and using them in combination may usefully reduce demands on the factor-producing cells. The use of a multiply acting hematopoietic factor may lower the amount of the factors that would be needed, probably reducing the likelihood of adverse side-effects.

Novel compounds of this invention are represented by a formula selected from the group consisting of:

$R_1-L_1-R_2$, $R_2-L_1-R_1$, $R_1-R_2$, and $R_2-R_1$

Where $R_1$ and $R_2$ are as defined above. $R_2$ is preferably a colony stimulating factor with a different but complementary activity than $R_1$. By complementary activity is meant activity which enhances or changes the response to another cell modulator. The $R_1$ polypeptide is joined either directly or through a linker segment to the $R_2$ polypeptide. The term "directly" defines multi-functional hematopoietic receptor agonists in which the polypeptides are joined without a peptide linker. Thus $L_1$ represents a chemical bond or polypeptide segment to which both $R_1$ and $R_2$ are joined in frame, most commonly $L_1$ is a linear peptide to which $R_1$ and $R_2$ are joined by amide bonds linking the carboxy terminus of $R_1$ to the amino terminus of $L_1$ and carboxy terminus of $L_1$ to the amino terminus of $R_2$. By "joined in frame" is meant that there is no translation termination or disruption between the reading frames of the DNA encoding $R_1$ and $R_2$.

A non-exclusive list of other growth factors, i.e. colony stimulating factors (CSFs), are cytokines, lymphokines, interleukins, hematopoietic growth factors which can be joined to (I), (II) or (III) include GM-CSF, G-CSF, c-mpl ligand (also known as TPO or MGDF), M-CSF, erythropoietin (EPO), IL-1, IL-4, IL-2, IL-3, IL-5, IL 6, IL-7, IL-8, IL-9, IL-10, IL-11, IL-12, IL-13, IL-15, LIF, flt3/flk2 ligand, human growth hormone, B-cell growth factor, B-cell differentiation factor, eosinophil differentiation factor and stem cell factor (SCF) also known as steel factor or c-kit ligand. Additionally, this invention encompasses the use of modified $R_1$ or $R_2$ molecules or mutated or modified DNA sequences encoding these $R_1$ or $R_2$ molecules. The present invention also includes multi-functional hematopoietic receptor agonists in which $R_1$ or $R_2$ is an hIL-3 variant, c-mpl ligand variant, or G-CSF variant. A "hIL-3 variant" is defined as a hIL-3 molecule which has amino acid substitutions and/or portions of hIL-3 deleted as disclosed in WO 94/12638, WO 94/12639 and WO 95/00646, as well as other variants known in the art. A "c-mpl ligand variant" is defined an c-mpl ligand molecule. which has amino acid substitutions and/or portions of c-mpl ligand deleted, disclosed in U.S. application Ser. No. 08/383,035 as well as other variants known in the art. A "G-CSF variant" is defined an G-CSF molecule which has amino acid substitutions and/or portions of G-CSF deleted, as disclosed herein, as well as other variants known in the art.

The linking group $(L_1)$ is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic characteristics which could interact with the functional protein domains and (4) provide steric separation of $R_1$ and $R_2$ such that $R_1$ and $R_2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the multi-functional hematopoietic receptor agonists.

Preferred $L_1$ linkers of the present invention include sequences selected from the group of formulas: $(Gly^3Ser)^n$ (SEQ ID NO:4), (Gly$^4$Ser)$^n$ (SEQ ID NO:5), (Gly$^5$Ser)$^n$ (SEQ ID NO:6), (Gly$^n$Ser)$^n$ (SEQ ID NO:7) or (AlaGlySer)$^n$ (SEQ ID NO:8).

One example of a highly-flexible linker is the glycine and serine-rich spacer region present within the pIII protein of the filamentous bacteriophages, e.g. bacteriophages M13 or fd (Schaller et al., *PNAS USA* 72: 737–741, 1975). This region provides a long, flexible spacer region between two domains of the pIII surface protein. The spacer region consists of the amino acid sequence:

GlyGlyGlySerGlyGlyGlySerGlyGlyGlySerGluGlyGlyGlySerGlu GlyGlyGlySerGluGlyGlyGlySerGluGlyGlyGlySerGlyGlyGlySer (SEQ ID NO:9).

The present invention also includes linkers in which an endopeptidase recognition sequence is included. Such a cleavage site may be valuable to separate the individual components of the multi-functional hematopoietic receptor agonist to determine if they are properly folded and active in vitro. Examples of various endopeptidases include, but are not limited to, plasmin, enterokinase, kallikrein, urokinase, tissue plasminogen activator, clostripain, chymosin, collagenase, Russell's viper venom protease, postproline cleavage enzyme, V8 protease, Thrombin and factor Xa.

Peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Preferred linkers of the present invention include sequences derived from murine IgG gamma 2b hinge region in which the cysteines have been changed to serines. These linkers may also include an endopeptidase cleavage site. Examples of such linkers include the following sequences:

IleSerGluProSerGlyProIleSerThrIleAsnProSerProProSerLys GluSerHisLysSerPro (SEQ ID NO:10) and IleGluGlyArgIleSerGluProSerGlyProIleSerThrIleAsnProSer ProProSerLysGluSerHisLysSerPro (SEQ ID NO:11).

The present invention is, however, not limited by the form, size or number of linker sequences employed and the only requirement of the linker is that functionally it does not interfere with the folding and function of the individual molecules of the multi-functional hematopoietic receptor agonist.

One aspect of the invention includes multi-functional hematopoietic receptor agonists which comprise a sequence rearranged c-mpl receptor agonist in which the cysteine(s) at position 7 and 151 of c-mpl ligand, have been substituted with another amino acid. Kaushansky et al. (*Blood* 86:255a Abstract 1008, 1995) teaches that all four of the cysteines at positions 7, 29, 85, and 151 are required for bioactivity. The presence of cysteines in a protein can cause problems in processing when the protein is being produced recombinantly in a bacterial host. Microbially produced cysteine-containing proteins may tend to form multimers which greatly complicate purification of the protein product. Several additional purification steps, such as reduction and reoxidation of the recombinant protein may be required to obtain the protein in the proper confirmation. Removal of one of the cysteine residues, with concurrent replacement by a chemically equivalent neutral amino acid, would be desirable, in order to simplify the isolation and purification of the molecule. However, the successful removal of cysteines from biologically active molecules is unpredictable, in that the tertiary structure in the absence of the normally formed disulfide bridges, can be substantially altered. A molecule in which a pair of cysteines at positions 7 and 151 are substituted with another amino acid may have one or more advantages including, but not limited to: 1) increased folding efficiency of the heterologously expressed protein; 2) elimination of mispaired disulfides, 3) use of milder refold conditions (ie. Guanidine vs. Urea); 4) increased purification yields, 5) increased protein solubility; and 6) increased protein stability.

Determination of the Linker $L_2$.

The length of the amino acid sequence of the linker $L_2$ to be used in $R_1$ and/or $R_2$ can be selected empirically or with guidance from structural information, or by using a combination of the two approaches.

When no structural information is available, a small series of linkers can be prepared for testing using a design whose length is varied in order to span a range from 0 to 50 Å and whose sequence is chosen in order to be consistent with surface exposure (hydrophilicity, Hopp & Woods, *Mol. Immunol.* 20: 483–489, 1983), Kyte & Doolittle, *J. Mol. Biol.* 157:105–132; solvent exposed surface area, Lee & Richards, *J. Mol. Biol.* 55:379–400, 1971) and the ability to adopt the necessary conformation with out deranging the conformation of $R^1$ or $R^2$ (conformationally flexible; Karplus & Schulz, *Naturwissenschaften* 72:212–213, 1985). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser (SEQ ID NO:12) repeated n times, where n is 1, 2, 3 or 4. Those skilled in the art will recognize that there are many such sequences that vary in length or composition that can serve as linkers with the primary consideration being that they be neither excessively long nor short (cf., Sandhu, *Critical Rev. Biotech.* 12: 437–462, 1992); if they are too long, entropy effects will likely destabilize the three-dimensional fold, and may also make folding kinetically impractical, and if they are too short, they will likely destabilize the molecule because of torsional or steric strain.

Those skilled in the analysis of protein structural information will recognize that using the distance between the chain ends, defined as the distance between the c-alpha carbons, can be used to define the length of the sequence to be used, or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser (SEQ ID NO:12) cassette approach mentioned above; or optionally a combination of the original sequence and new sequence having the appropriate total length may be used.

Determination of the Amino and Carboxyl Termini of $R_1$ and $R_2$

Sequences of $R_1$ and $R_2$ capable of folding to biologically active states can be prepared by appropriate selection of the beginning (amino terminus) and ending (carboxyl terminus) positions from within the original polypeptide chain while using the linker sequence $L_2$ as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence.

It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein crystals or nuclear magnetic resonance spectroscopy of protein solutions. Examples of structural information that are relevant to the identification of breakpoint regions include the location and type of protein secondary structure (alpha and 3–10 helices, parallel and anti-parallel beta sheets, chain reversals and turns, and loops; Kabsch & Sander, *Biopolymers* 22: 2577–2637, 1983), the degree of solvent exposure of amino acid residues, the extent and type of interactions of residues with one another (Chothia, *Ann. Rev. Biochem.* 53:537–572, 1984) and the static and dynamic distribution of conformations along the polypeptide chain (Alber & Mathews, *Methods Enzymol.* 154: 511–533, 1987). In some cases additional information is known about solvent exposure of residues; one example is a site of post-translational attachment of carbohydrate which is necessarily on the surface of the protein. When experimental structural information is not available, or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile & Salvatore, *Eur. J. Biochem.* 218:603–621, 1993) Thus using either the experimentally derived structural information or predictive methods (e.g., Srinivisan & Rose Proteins: *Struct., Funct. & Genetics*, 22: 81–99, 1995) the parental amino acid sequence is inspected to classify regions according to whether or not they are integral to the maintenance of secondary and tertiary structure. The occurrence of sequences within regions that are known to be involved in periodic secondary structure (alpha and 3–10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region.

Non-covalent Multifunctional Hematopoietic Growth Factors

An alternative method for connecting two hematopoietic growth factors is by means of a non-covalent interaction. Such complexed proteins can be described by one of the formulae:

$R_1—C_1+R_2—C_2$; or $C_1—R_1+C_2—R_2$; $C_1—R_1+R_2—C_2$; or $C_1—R_1+R_2—C_2$.

$R_1$ and $R_2$ are as is defined above. Domains $C_1$ and $C_2$ are either identical or non-identical chemical structures, typically proteinaceous, which can form a non-covalent, specific association. Complexes between $C_1$ and $C_2$ result in a one-to-one stoichiometric relationship between $R_1$ and $R_2$ for each complex. Examples of domains which associate are "leucine zipper" domains of transcription factors, dimerization domains of bacterial transcription repressors and immunoglobulin constant domains. Covalent bonds link $R_1$ and $C_1$, and $R_2$ and $C_2$, respectively. As indicated in the formulae, the domains $C_1$ and $C_2$ can be present either at the N-terminus or C-terminus of their corresponding hematopoietic growth factor (R). These multimerization domains ($C_1$ and $C_2$) include those derived from the bZIP family of proteins (Abel et al., *Nature* 341:24–25, 1989; Landshulz et al., *Science* 240:1759–1764, 1988; Pu et al., *Nuc. Acid Res.* 21:4348–4355, 1993; Kozarides et al., *Nature* 336:646–651, 1988), as well as multimerization domains of the helix-loop-helix family of proteins (Abel et al., *Nature* 341:24–25, 1989; Murre et al., *Cell* 56:777–783, 1989; Tapscott et al., *Science* 242:405–411, 1988; Fisher et al., *Genes & Dev.* 5:2342–2352, 1991). Preferred multi-functional hematopoietic receptor agonists of the present invention include colony stimulating factors dimerized by virtue of their incorporation as translational multi-functional hematopoietic receptor agonists with the leucine zipper dimerization domains of the bZIP family proteins Fos and Jun. The leucine zipper domain of Jun is capable of interacting with identical domains. On the other hand, the leucine zipper domain of Fos interacts with the Jun leucine zipper domain, but does not interact with other Fos leucine zipper domains. Mixtures of Fos and Jun predominantly result in formation of Fos-Jun heterodimers. Consequently, when joined to colony stimulating factors, the Jun domain can be used to direct the formation of either homo- or heterodimers. Preferential formation of heterodimers can be achieved if one of the colony stimulating factor partners is engineered to possess the Jun leucine zipper domain while the other is engineered to possess the Fos zipper.

Additional peptide sequences may also be added to facilitate purification or identification of multi-functional hematopoietic receptor agonist proteins (e.g., poly-His). A highly antigenic peptide may also be added that would enable rapid assay and facile purification of the multi-functional hematopoietic receptor agonist protein by a specific monoclonal antibody.

"Mutant amino acid sequence," "mutant protein", "variant protein", "mutein", or "mutant polypeptide" refers to a polypeptide having an amino acid sequence which varies from a native sequence due to amino acid deletions, substitutions, or both, or is encoded by a nucleotide sequence intentionally made variant from a native sequence.

"Native sequence" refers to an amino acid or nucleic acid sequence which is identical to a wild-type or native form of a gene or protein.

Hematopoietic growth factors can be characterized by their ability to stimulate colony formation by human hematopoietic progenitor cells. The colonies formed include erythroid, granulocyte, megakaryocyte, granulocytic macrophages and mixtures thereof. Many of the hematopoietic growth factors have demonstrated the ability to restore bone marrow function and peripheral blood cell populations to therapeutically beneficial levels in studies performed initially in primates and subsequently in humans. Many or all of these biological activities of hematopoietic growth factors involve signal transduction and high affinity receptor binding. Multi-functional hematopoietic receptor agonists of the present invention may exhibit useful properties such as having similar or greater biological activity when compared to a single factor or by having improved half-life or decreased adverse side effects, or a combination of these properties.

Multi-functional hematopoietic receptor agonists which have little or no agonist activity maybe useful as antagonists, as antigens for the production of antibodies for use in immunology or immunotherapy, as genetic probes or as intermediates used to construct other useful hIL-3 muteins.

Biological activity of the multi-functional hematopoietic receptor agonist proteins of the present invention can be determined by DNA synthesis in factor-dependent cell lines or by counting the colony forming units in an in vitro bone marrow assay.

The multi-functional hematopoietic receptor agonists of the present invention may have an improved therapeutic profile as compared to single acting hematopoietic agonists. For example, some multi-functional hematopoietic receptor agonists of the present invention may have a similar or more potent growth factor activity relative to other hematopoietic agonists without having a similar or corresponding increase in side-effects.

The present invention also includes the DNA sequences which code for the multi-functional hematopoietic receptor agonist proteins, DNA sequences which are substantially similar and perform substantially the same function, and DNA sequences which differ from the DNAs encoding the multi-functional hematopoietic receptor agonists of the invention only due to the degeneracy of the genetic code. Also included in the present invention are the oligonucleotide intermediates used to construct the mutant DNAs and the polypeptides coded for by these oligonucleotides.

Genetic engineering techniques now standard in the art (U.S. Pat. No. 4,935,233 and Sambrook et al., "Molecular Cloning A Laboratory Manual", Cold Spring Harbor Laboratory, 1989) may be used in the construction of the DNA sequences of the present invention. One such method is cassette mutagenesis (Wells et al., Gene 34:315–323, 1985) in which a portion of the coding sequence in a plasmid is replaced with synthetic oligonucleotides that encode the desired amino acid substitutions in a portion of the gene between two restriction sites.

Pairs of complementary synthetic oligonucleotides encoding the desired gene can be made and annealed to each other. The DNA sequence of the oligonucleotide would encode sequence for amino acids of desired gene with the exception of those substituted and/or deleted from the sequence.

Plasmid DNA can be treated with the chosen restriction endonucleases then ligated to the annealed oligonucleotides. The ligated mixtures can be used to transform competent JM101 cells to resistance to an appropriate antibiotic. Single colonies can be picked and the plasmid DNA examined by restriction analysis and/or DNA sequencing to identify plasmids with the desired genes.

Cloning of the DNA sequences of the novel multifunctional hematopoietic agonists wherein at least one of the with the DNA sequence of the other colony stimulating factor may be accomplished by the use of intermediate vectors. Alternatively one gene can be cloned directly into a vector containing the other gene. Linkers and adapters can be used for joining the DNA sequences, as well as replacing lost sequences, where a restriction site was internal to the region of interest. Thus genetic material (DNA) encoding one polypeptide, peptide linker, and the other polypeptide is inserted into a suitable expression vector which is used to transform bacteria, yeast, insect cells or mammalian cells. The transformed organism is grown and the protein isolated by standard techniques. The resulting product is therefore a new protein which has a colony stimulating factor joined by a linker region to a second colony stimulating factor.

Another aspect of the present invention provides plasmid DNA vectors for use in the expression of these novel multi-functional hematopoietic receptor agonists. These vectors contain the novel DNA sequences described above which code for the novel polypeptides of the invention. Appropriate vectors which can transform microorganisms capable of expressing the multi-functional hematopoietic receptor agonists include expression vectors comprising nucleotide sequences coding for the multi-functional hematopoietic receptor agonists joined to transcriptional and translational regulatory sequences which are selected according to the host cells used.

Vectors incorporating modified sequences as described above are included in the present invention and are useful in the production of the multi-functional hematopoietic receptor agonist polypeptides. The vector employed in the method also contains selected regulatory sequences in operative association with the DNA coding sequences of the invention and which are capable of directing the replication and expression thereof in selected host cells.

As another aspect of the present invention, there is provided a method for producing the novel multi-functional hematopoietic receptor agonists. The method of the present invention involves culturing suitable cells or cell line, which has been transformed with a vector containing a DNA sequence coding for expression of a novel multi-functional hematopoietic receptor agonist. Suitable cells or cell lines may be bacterial cells. For example, the various strains of $E.$ $coli$ are well-known as host cells in the field of biotechnology. Examples of such strains include $E.$ $coli$ strains JM101 (Yanish-Perron et al. Gene 33: 103–119, 1985) and MON105 (Obukowicz et al., Applied Environmental Microbiology 58: 1511–1523, 1992). Also included in the present invention is the expression of the multi-functional hematopoietic receptor agonist protein utilizing a chromosomal expression vector for $E.$ $coli$ based on the bacteriophage Mu (Weinberg et al., Gene 126: 25–33, 1993). Various strains of $B.$ $subtilis$ may also be employed in this method. Many strains of yeast cells known to those skilled in the art are also available as host cells for expression of the polypeptides of the present invention. When expressed in the $E.$ $coli$ cytoplasm, the gene encoding the multi-functional hematopoietic receptor agonists of the present invention may also be constructed such that at the 5′ end of the gene codons are added to encode $Met^{-2}$-$Ala^{-1}$- or $Met^{-1}$ at the N-terminus of the protein. The N termini of proteins made in the cytoplasm of $E.$ $coli$ are affected by post-translational processing by methionine aminopeptidase (Ben Bassat et al., J. Bac.

169:751–757, 1987) and possibly by other peptidases so that upon expression the methionine is cleaved off the N-terminus. The multi-functional hematopoietic receptor agonists of the present invention may include multi-functional hematopoietic receptor agonist polypeptides having $Met^{-1}$, $Ala^{-1}$ or $Met^{-2}$-$Ala^{-1}$ at the N-terminus. These mutant multi-functional hematopoietic receptor agonists may also be expressed in *E. coli* by fusing a secretion signal peptide to the N-terminus. This signal peptide is cleaved from the polypeptide as part of the secretion process.

Also suitable for use in the present invention are mammalian cells, such as Chinese hamster ovary cells (CHO). General methods for expression of foreign genes in mammalian cells are reviewed in Kaufman, R. J., 1987) Genetic Engineering, Principles and Methods, Vol. 9, J. K. Setlow, editor, Plenum Press, New York. An expression vector is constructed in which a strong promoter capable of functioning in mammalian cells drives transcription of a eukaryotic secretion signal peptide coding region, which is translationally joined to the coding region for the multi-functional hematopoietic receptor agonist. For example, plasmids such as pcDNA I/Neo, pRc/RSV, and pRc/CMV (obtained from Invitrogen Corp., San Diego, Calif.) can be used. The eukaryotic secretion signal peptide coding region can be from the gene itself or it can be from another secreted mammalian protein (Bayne, M. L. et al., *Proc. Natl. Acad. Sci. USA* 84: 2638–2642, 1987). After construction of the vector containing the gene, the vector DNA is transfected into mammalian cells. Such cells can be, for example, the COS7, HeLa, BHK, CHO, or mouse L lines. The cells can be cultured, for example, in DMEM media (JRH Scientific). The polypeptide secreted into the media can be recovered by standard biochemical approaches following transient expression for 24–72 hours after transfection of the cells or after establishment of stable cell lines following selection for antibiotic resistance. The selection of suitable mammalian host cells and methods for transformation, culture, amplification, screening and product production and purification are known in the art. See, e.g., Gething and Sambrook, *Nature*, 293:620–625, 1981), or alternatively, Kaufman et al, *Mol. Cell. Biol.*, 5(7):1750–1759, 1985) or Howley et al., U.S. Pat. No. 4,419,446. Another suitable mammalian cell line is the monkey COS-1 cell line. A similarly useful mammalian cell line is the CV-1 cell line.

Where desired, insect cells may be utilized as host cells in the method of the present invention. See, e.g., Miller et al., *Genetic Engineering*, 8:277–298 (Plenum Press 1986) and references cited therein. In addition, general methods for expression of foreign genes in insect cells using Baculovirus vectors are described in: Summers, M. D. and Smith, G. E., 1987)—A manual of methods for Baculovirus vectors and insect cell culture procedures, Texas Agricultural Experiment Station Bulletin No. 1555. An expression vector is constructed comprising a Baculovirus transfer vector, in which a strong Baculovirus promoter (such as the polyhedron promoter) drives transcription of a eukaryotic secretion signal peptide coding region, which is translationally joined to the coding region for the multi-functional hematopoietic receptor agonist polypeptide. For example, the plasmid $pVL_{1392}$ (obtained from Invitrogen Corp., San Diego, Calif.) can be used. After construction of the vector carrying the gene encoding the multi-functional hematopoietic receptor agonist polypeptide, two micrograms of this DNA is co-transfected with one microgram of Baculovirus DNA (see Summers & Smith, 1987) into insect cells, strain SF9. Pure recombinant Baculovirus carrying the multi-functional hematopoietic receptor agonist is used to infect cells cultured, for example, in Excell 401 serum-free medium (JRH Biosciences, Lenexa, Kans.). The multi-functional hematopoietic receptor agonist secreted into the medium can be recovered by standard biochemical approaches. Supernatants from mammalian or insect cells expressing the multi-functional hematopoietic receptor agonist protein can be first concentrated using any of a number of commercial concentration units.

The multi-functional hematopoietic receptor agonists of the present invention may be useful in the treatment of diseases characterized by decreased levels of either myeloid, erythroid, lymphoid, or megakaryocyte cells of the hematopoietic system or combinations thereof. In addition, they may be used to activate mature myeloid and/or lymphoid cells. Among conditions susceptible to treatment with the polypeptides of the present invention is leukopenia, a reduction in the number of circulating leukocytes (white cells) in the peripheral blood. Leukopenia may be induced by exposure to certain viruses or to radiation. It is often a side effect of various forms of cancer therapy, e.g., exposure to chemotherapeutic drugs, radiation and of infection or hemorrhage. Therapeutic treatment of leukopenia with these multi-functional hematopoietic receptor agonists of the present invention may avoid undesirable side effects caused by treatment with presently available drugs.

The multi-functional hematopoietic receptor agonists of the present invention may be useful in the treatment of neutropenia and, for example, in the treatment of such conditions as aplastic anemia, cyclic neutropenia, idiopathic neutropenia, Chediak-Higashi syndrome, systemic lupus erythematosus (SLE), leukemia, myelodysplastic syndrome and myelofibrosis.

The multi-functional hematopoietic receptor agonist of the present invention may be useful in the treatment or prevention of thrombocytopenia. Currently the only therapy for thrombocytopenia is platelet transfusion which are costly and carry the significant risks of infection (HIV, HBV) and alloimmunization. The multi-functional hematopoietic receptor agonist may alleviate or diminish the need for platelet transfusion. Severe thrombocytopenia may result from genetic defects such as Fanconi's Anemia, Wiscott-Aldrich, or May Hegglin syndromes. Acquired thrombocytopenia may result from auto- or allo-antibodies as in Immune Thrombocytopenia Purpura, Systemic Lupus Erythromatosis, hemolytic anemia, or fetal maternal incompatibility. In addition, splenomegaly, disseminated intravascular coagulation, thrombotic thrombocytopenic purpura, infection or prosthetic heart valves may result in thrombocytopenia. Severe thrombocytopenia may also result from chemotherapy and/or radiation therapy or cancer. Thrombocytopenia may also result from marrow invasion by carcinoma, lymphoma, leukemia or fibrosis.

The multi-functional hematopoietic receptor agonists of the present invention may be useful in the mobilization of hematopoietic progenitors and stem cells in peripheral blood. Peripheral blood derived progenitors have been shown to be effective in reconstituting patients in the setting of autologous marrow transplantation. Hematopoietic growth factors including G-CSF and GM-CSF have been shown to enhance the number of circulating progenitors and stem cells in the peripheral blood. This has simplified the procedure for peripheral stem cell collection and dramatically decreased the cost of the procedure by decreasing the number of pheresis required. The multi-functional hematopoietic receptor agonist may be useful in mobilization of stem cells and further enhance the efficacy of peripheral stem cell transplantation.

The multi-functional hematopoietic receptor agonists of the present invention may also be useful in the ex vivo expansion of hematopoietic progenitors and stem cells. Colony stimulating factors (CSFs), such as hIL-3, have been administered alone, co-administered with other CSFs, or in combination with bone marrow transplants subsequent to high dose chemotherapy to treat the neutropenia and thrombocytopenia which are often the result of such treatment. However the period of severe neutropenia and thrombocytopenia may not be totally eliminated. The myeloid lineage, which is comprised of monocytes (macrophages), granulocytes (including neutrophils) and megakaryocytes, is critical in preventing infections and bleeding which can be life-threatening. Neutropenia and thrombocytopenia may also be the result of disease, genetic disorders, drugs, toxins, radiation and many therapeutic treatments such as conventional oncology therapy.

Bone marrow transplants have been used to treat this patient population. However, several problems are associated with the use of bone marrow to reconstitute a compromised hematopoietic system including: 1) the number of stem cells in bone marrow, spleen, or peripheral blood is limited, 2) Graft Versus Host Disease, 3) graft rejection and 4) possible contamination with tumor cells. Stem cells make up a very small percentage of the nucleated cells in the bone marrow, spleen and peripheral blood. It is clear that a dose response exists such that a greater number of stem cells will enhance hematopoietic recovery. Therefore, the in vitro expansion of stem cells should enhance hematopoietic recovery and patient survival. Bone marrow from an allogeneic donor has been used to provide bone marrow for transplant. However, Graft Versus Host Disease and graft rejection limit bone marrow transplantation even in recipients with HLA-matched sibling donors. An alternative to allogeneic bone marrow transplants is autologous bone marrow transplants. In autologous bone marrow transplants, some of the patient's own marrow is harvested prior to myeloblative therapy, e.g. high dose chemotherapy, and is transplanted back into the patient afterwards. Autologous transplants eliminate the risk of Graft Versus Host Disease and graft rejection. However, autologous bone marrow transplants still present problems in terms of the limited number of stems cells in the marrow and possible contamination with tumor cells. The limited number of stem cells may be overcome by ex-vivo expansion of the stem cells. In addition, stem cells can be specifically isolated, based on the presence of specific surface antigens such as CD34+ in order to decrease tumor cell contamination of the marrow graft.

The following patents contain further details on separating stem cells, CD34+ cells, culturing the cells with hematopoietic factors, the use of the cells for the treatment of patients with hematopoietic disorders and the use of hematopoietic factors for cell expansion and gene therapy.

U.S. Pat. No. 5,061,620 relates to compositions comprising human hematopoietic stem cells provided by separating the stem cells from dedicated cells.

U.S. Pat. No. 5,199,942 describes a method for autologous hematopoietic cell transplantation comprising: (1) obtaining hematopoietic progenitor cells from a patient; (2) ex-vivo expansion of cells with a growth factor selected from the group consisting of IL-3, flt3 ligand, c-kit ligand, GM-CSF, IL-1, GM-CSF/IL-3 fusion protein and combinations thereof; (3) administering cellular preparation to a patient.

U.S. Pat. No. 5,240,856 relates to a cell separator that includes an apparatus for automatically controlling the cell separation process.

WO 91/16116 describes devices and methods for selectively isolating and separating target cells from a mixture of cells.

WO 91/18972 describes methods for in vitro culturing of bone marrow, by incubating suspension of bone marrow cells, using a hollow fiber bioreactor.

WO 92/18615 relates to a process for maintaining and expanding bone marrow cells, in a culture medium containing specific mixtures of cytokines, for use in transplants.

WO 93/08268 describes a method for selectively expanding stem cells, comprising the steps of (a) separating CD34+ stem cells from other cells and (b) incubating the separated cells in a selective medium, such that the stem cells are selectively expanded.

WO 93/18136 describes a process for in vitro support of mammalian cells derived from peripheral blood.

WO 93/18648 relates to a composition comprising human neutrophil precursor cells with a high content of myeloblasts and promyelocytes for treating genetic or acquired neutropenia.

WO 94/08039 describes a method of enrichment for human hematopoietic stem cells by selection for cells which express c-kit protein.

WO 94/11493 describes a stem cell population that are CD34+ and small in size, which are isolated using a counterflow elutriation method.

WO 94/27698 relates to a method combining immunoaffinity separation and continuous flow centrifugal separation for the selective separation of a nucleated heterogeneous cell population from a heterogeneous cell mixture.

WO 94/25848 describes a cell separation apparatus for collection and manipulation of target cells.

The long term culturing of highly enriched CD34+ precursors of hematopoietic progenitor cells from human bone marrow in cultures containing IL-1a, IL-3, IL-6 or GM-CSF is discussed in Brandt et al *J. Clin. Invest.* 86:932–941, 1990).

One aspect of the present invention provides a method for selective ex-vivo expansion of stem cells. The term "stem cell" refers to the totipotent hematopoietic stem cells as well as early precursors and progenitor cells which can be isolated from bone marrow, spleen or peripheral blood. The term "expansion" refers to the differentiation and proliferation of the cells. The present invention provides a method for selective ex-vivo expansion of stem cells, comprising the steps of: (a) separating stem cells from other cells, (b) culturing said separated stem cells with a selective media which contains multi-functional hematopoietic receptor agonist protein(s) and (c) harvesting said stems cells. Stem cells, as well as committed progenitor cells destined to become neutrophils, erythrocytes, platelets, etc. may be distinguished from most other cells by the presence or absence of particular progenitor marker antigens, such as CD34, that are present on the surface of these cells and/or by morphological characteristics. The phenotype for a highly enriched human stem cell fraction is reported as CD34+, Thy-1+ and lin-, but it is to be understood that the present invention is not limited to the expansion of this stem cell population. The CD34+ enriched human stem cell fraction can be separated by a number of reported methods, including affinity columns or beads, magnetic beads or flow cytometry using antibodies directed to surface antigens such as the CD34+. Further, physical separation methods such as counterflow elutriation may be used to enrich hematopoietic progenitors. The CD34+ progenitors are heterogeneous, and may be divided into several sub-populations characterized by the presence or absence of co-expression of different lineage associated cell surface associated molecules. The most immature progenitor cells do not express any known lineage associated markers, such as HLA-DR or CD38, but they may express CD90(thy-1). Other surface antigens such as CD33, CD38, CD41, CD71, HLA-DR or c-kit can also be used to selectively isolate hematopoietic progenitors. The separated cells can be incubated in selected medium in a culture flask, sterile bag or in hollow fibers. Various colony stimulating factors may be utilized in order to selectively expand cells. Representative factors that have been utilized for ex-vivo expansion of bone marrow include, c-kit ligand, IL-3, G-CSF, GM-CSF, IL-1, IL-6, IL-11, flt-3 ligand or combinations thereof. The proliferation of the stem cells can be monitored by enumerating the number of stem cells and other cells, by standard techniques (e.g. hemacytometer, CFU, LTCIC) or by flow cytometry prior and subsequent to incubation.

Several methods for ex-vivo expansion of stem cells have been reported utilizing a number of selection methods and expansion using various colony stimulating factors including c-kit ligand (Brandt et al., *Blood* 83:1507–1514 [1994], McKenna et al., *Blood* 86:3413–3420 [1995]), IL-3 (Brandt et al., *Blood* 83:1507–1514 [1994], Sato et al., *Blood* 82:3600–3609 [1993]), G-CSF (Sato et al., *Blood* 82:3600–3609 [1993]), GM-CSF (Sato et al., *Blood* 82:3600–3609 [1993]), IL-1 (Muench et al., *Blood* 81:3463–3473 [1993]), IL-6 (Sato et al., *Blood* 82:3600–3609 [1993]), IL-11 (Lemoli et al., *Exp. Hem.* 21:1668–1672 [1993], Sato et al., *Blood* 82:3600–3609 [1993]), flt-3 ligand (McKenna et al., *Blood* 86:3413 3420 [1995]) and/or combinations thereof (Brandt et al., *Blood* 83:1507 1514 [1994], Haylock et al., *Blood* 80:1405–1412 [1992], Koller et al., *Biotechnology* 11:358–363 [1993], (Lemoli et al., *Exp. Hem.* 21:1668–1672 [1993]), McKenna et al., *Blood* 86:3413–3420 [1995], Muench et al., *Blood* 81:3463–3473 [1993], Patchen et al., *Biotherapy* 7:13–26 [1994], Sato et al., *Blood* 82:3600–3609 [1993], Smith et al., *Exp. Hem.* 21:870–877 [1993], Steen et al., *Stem Cells* 12:214–224 [1994], Tsujino et al., *Exp. Hem.* 21:1379–1386 [1993]). Among the individual colony stimulating factors, hIL-3 has been shown to be one of the most potent in expanding peripheral blood CD34+ cells (Sato et al., *Blood* 82:3600–3609 [1993], Kobayashi et al., *Blood* 73:1836–1841 [1989]). However, no single factor has been shown to be as effective as the combination of multiple factors. The present invention provides methods for ex vivo expansion that utilize multi-functional hematopoietic receptor agonists that are more effective than a single factor alone.

Another aspect of the invention provides methods of sustaining and/or expanding hematopoietic precursor cells which includes inoculating the cells into a culture vessel which contains a culture medium that has been conditioned by exposure to a stromal cell line such as HS-5 (WO 96/02662, Roecklein and Torok-Strob, *Blood* 85:997–1105, 1995) that has been supplemented with a multi-functional hematopoietic receptor agonist of the present invention.

Another projected clinical use of growth factors has been in the in vitro activation of hematopoietic progenitors and stem cells for gene therapy. Due to the long life-span of hematopoietic progenitor cells and the distribution of their daughter cells throughout the entire body, hematopoietic progenitor cells are good candidates for ex vivo gene transfection. In order to have the gene of interest incorporated into the genome of the hematopoietic progenitor or stem cell one needs to stimulate cell division and DNA replication. Hematopoietic stem cells cycle at a very low frequency which means that growth factors may be useful to promote gene transduction and thereby enhance the clinical prospects for gene therapy. Potential applications of gene therapy (review Crystal, *Science* 270:404–410 [1995]) include; 1) the treatment of many congenital metabolic disorders and immunodeficiencies (Kay and Woo, *Trends Genet.* 10:253–257 [1994]), 2) neurological disorders (Friedmann, *Trends Genet.* 10:210–214 [1994]), 3) cancer (Culver and Blaese, *Trends Genet.* 10:174–178 [1994]) and 4) infectious diseases (Gilboa and Smith, *Trends Genet.* 10:139–144 [1994]).

There are a variety of methods, known to those with skill in the art, for introducing genetic material into a host cell. A number of vectors, both viral and non-viral have been developed for transferring therapeutic genes into primary cells. Viral based vectors include; 1) replication deficient recombinant retrovirus (Boris-Lawrie and Temin, *Curr. Opin. Genet. Dev.* 3:102–109 [1993], Boris-Lawrie and Temin, *Annal. New York Acad. Sci.* 716:59–71 [1994], Miller, *Current Top. Microbiol. Immunol.* 158:1–24 [1992]) and replication-deficient recombinant adenovirus (Berkner, *BioTechniques* 6:616–629 [1988], Berkner, *Current Top. Microbiol. Immunol.* 158:39–66 [1992], Brody and Crystal, *Annal. New York Acad. Sci.* 716:90–103 [1994]). Non-viral based vectors include protein/DNA complexes (Cristiano et al., *PNAS USA.* 90:2122–2126 [1993], Curiel et al., *PNAS USA* 88:8850–8854 [1991], Curiel, *Annal. New York Acad. Sci.* 716:36–58 [1994]), electroporation and liposome mediated delivery such as cationic liposomes (Farhood et al., *Annal. New York Acad. Sci.* 716:23–35 [1994]).

The present invention provides an improvement to the existing methods of expanding hematopoietic cells, which new genetic material has been introduced, in that it provides methods utilizing multi-functional hematopoietic receptor agonist proteins that have improved biological activity, including an activity not seen by any single colony stimulation factor.

Many drugs may cause bone marrow suppression or hematopoietic deficiencies. Examples of such drugs are AZT, DDI, alkylating agents and anti-metabolites used in chemotherapy, antibiotics such as chloramphenicol, penicillin, gancyclovir, daunomycin and sulfa drugs, phenothiazones, tranquilizers such as meprobamate, analgesics such as aminopyrine and dipyrone, anti-convulsants such as phenytoin or carbamazepine, antithyroids such as propylthiouracil and methimazole and diuretics. The multi-functional hematopoietic receptor agonists of the present invention may be useful in preventing or treating the bone marrow suppression or hematopoietic deficiencies which often occur in patients treated with these drugs.

Hematopoietic deficiencies may also occur as a result of viral, microbial or parasitic infections and as a result of treatment for renal disease or renal failure, e.g., dialysis. The multi-functional hematopoietic receptor agonists of the present invention may be useful in treating such hematopoietic deficiencies.

The treatment of hematopoietic deficiency may include administration of a pharmaceutical composition containing the multi-functional hematopoietic receptor agonists to a patient. The multi-functional hematopoietic receptor agonists of the present invention may also be useful for the activation and amplification of hematopoietic precursor cells by treating these cells in vitro with the multi-functional hematopoietic receptor agonist proteins of the present invention prior to injecting the cells into a patient.

Various immunodeficiencies, e.g., in T and/or B lymphocytes, or immune disorders, e.g., rheumatoid arthritis, may also be beneficially affected by treatment with the multi-functional hematopoietic receptor agonists of the present invention. Immunodeficiencies may be the result of viral infections, e.g., HTLVI, HTLVII, HTLVIII, severe exposure to radiation, cancer therapy or the result of other medical treatment. The multi-functional hematopoietic receptor agonists of the present invention may also be employed, alone or in combination with other colony stimulating factors, in the treatment of other blood cell deficiencies, including thrombocytopenia (platelet deficiency), or anemia. Other uses for these novel polypeptides are the in vivo and ex vivo treatment of patients recovering from bone marrow transplants, and in the development of monoclonal and polyclonal antibodies generated by standard methods for diagnostic or therapeutic use.

Other aspects of the present invention are methods and therapeutic compositions for treating the conditions referred to above. Such compositions comprise a therapeutically effective amount of one or more of the multi-functional hematopoietic receptor agonists of the present invention in a mixture with a pharmaceutically acceptable carrier. This composition can be administered either parenterally, intravenously or subcutaneously. When administered, the therapeutic composition for use in this invention is preferably in the form of a pyrogen-free, parenterally acceptable aqueous solution. The preparation of such a parenterally acceptable protein solution, having due regard to pH, isotonicity, stability and the like, is within the skill of the art.

The dosage regimen involved in a method for treating the above-described conditions will be determined by the attending physician considering various factors which modify the action of drugs, e.g., the condition, body weight, sex and diet of the patient, the severity of any infection, time of administration and other clinical factors. Generally, a daily regimen may be in the range of 0.2–150 $\mu$g/kg of multi-functional hematopoietic receptor agonist protein per kilogram of body weight. Dosages would be adjusted relative to the activity of a given multi-functional hematopoietic receptor agonist protein and it would not be unreasonable to note that dosage regimens may include doses as low as 0.1 microgram and as high as 1 milligram per kilogram of body weight per day. In addition, there may exist specific circumstances where dosages of multi-functional hematopoietic receptor agonist would be adjusted higher or lower than the range of 0.2–150 micrograms per kilogram of body weight. These include co-administration with other colony stimulating factors or IL-3 variants or growth factors; co-administration with chemotherapeutic drugs and/or radiation; the use of glycosylated multi-functional hematopoietic receptor agonist protein; and various patient-related issues mentioned earlier in this section. As indicated above, the therapeutic method and compositions may also include co-administration with other human factors. A non-exclusive list of other appropriate colony stimulating factors (CSFs), cytokines, lymphokines, hematopoietic growth factors and interleukins for simultaneous or serial co-administration with the polypeptides of the present invention includes GM-CSF, G-CSF, c-mpl ligand (also known as TPO or MGDF), M-CSF, erythropoietin (EPO), IL-1, IL-4, IL-2, IL-3, IL-5, IL-6, IL-7, IL-8, IL-9, IL-10, IL-11, IL-12, IL-13, IL-15, IL-16, LIF, flt3/flk2 ligand, B-cell growth factor, B-cell differentiation factor and eosinophil differentiation factor, stem cell factor (SCF) also known as steel factor or c-kit ligand, or combinations thereof. The dosage recited above would be adjusted to compensate for such additional components in the therapeutic composition. Progress of the treated patient can be monitored by periodic assessment of the hematological profile, e.g., differential cell count and the like.

Materials and Methods

Unless noted otherwise, all specialty chemicals were obtained from Sigma, Co. (St. Louis, Mo.). Restriction endonucleases and T4 DNA ligase were obtained from New England Biolabs (Beverly, Mass.) or Boehringer Mannheim (Indianapolis, Ind.).

Transformation of *E. coli* Strains

*E. coli* strains, such as DH5a™ (Life Technologies, Gaithersburg, Md.) and TG1 (Amersham Corp., Arlington Heights, Ill.) are used for transformation of ligation reactions and are the source of plasmid DNA for transfecting mammalian cells. *E. coli* strains, such as JM101 (Yanisch-Perron, et al., *Gene*, 33: 103–119, 1985) and MON105 (Obukowicz, et al., *Appl. and Envir. Micr.*, 58: 1511–1523, 1992) can be used for expressing the multi-functional hematopoietic receptor agonist of the present invention in the cytoplasm or periplasmic space.

MON105 ATCC#55204: F−, lambda−, IN(rrnD, rrE)1, rpoD+, rpoH358

DH5α™: F−, phi80dlacZdeltaM15, delta(lacZYA-argF) U169, deoR, recA1, enda1, hsdR17(rk−, mk+), phoA, supE441amda−, thi−1, gyrA96, relA1

TG1: delta(lac-pro), supE, thi−1, hsdD5/F'(traD36, proA+ B+, lacIq, lacZdeltaM15)

JM101 ATCC#33876: delta (pro lac), supE, thi, F'(traD36, proA+B+, lacIq, lacZdeltaM15)

DH5α™ Subcloning efficiency cells are purchased as competent cells and are ready for transformation using the manufacturer's protocol, while both *E. coli* strains TG1 and MON105 are rendered competent to take up DNA using a $CaCl_2$ method. Typically, 20 to 50 mL of cells are grown in LB medium (1% bacto-tryptone, 0.5% bacto-yeast extract, 150 mM NaCl) to a density of approximately 1.0 optical density unit at 600 nanometers (OD600) as measured by a Baush & Lomb Spectronic spectrophotometer (Rochester, N.Y.). The cells are collected by centrifugation and resuspended in one-fifth culture volume of $CaCl_2$ solution (50 mM $CaCl_2$, 10 mM Tris-Cl, pH7.4) and are held at 4° C. for 30 minutes. The cells are again collected by centrifugation and resuspended in one-tenth culture volume of $CaCl_2$ solution. Ligated DNA is added to 0.2 mL of these cells, and the samples are held at 4° C. for 30–60 minutes. The samples are shifted to 42° C. for two minutes and 1.0 mL of LB is added prior to shaking the samples at 37° C. for one hour. Cells from these samples are spread on plates (LB medium plus 1.5% bacto-agar) containing either ampicillin (100 micrograms/mL, $\mu$g/mL) when selecting for ampicillin-resistant transformants, or spectinomycin.(75 $\mu$g/mL) when selecting for spectinomycin-resistant transformants. The plates are incubated overnight at 37° C. Colonies are picked and inoculated into LB plus appropriate antibiotic (100 $\mu$g/mL ampicillin or 75 $\mu$g/mL spectinomycin) and are grown at 37° C. while shaking.

Methods for Creation of Genes With New N-Terminus/C-terminus

Method I. Creation of Genes With New N-Terminus/C-terminus Which Contain a Linker Region ($L_2$).

Figure 2:
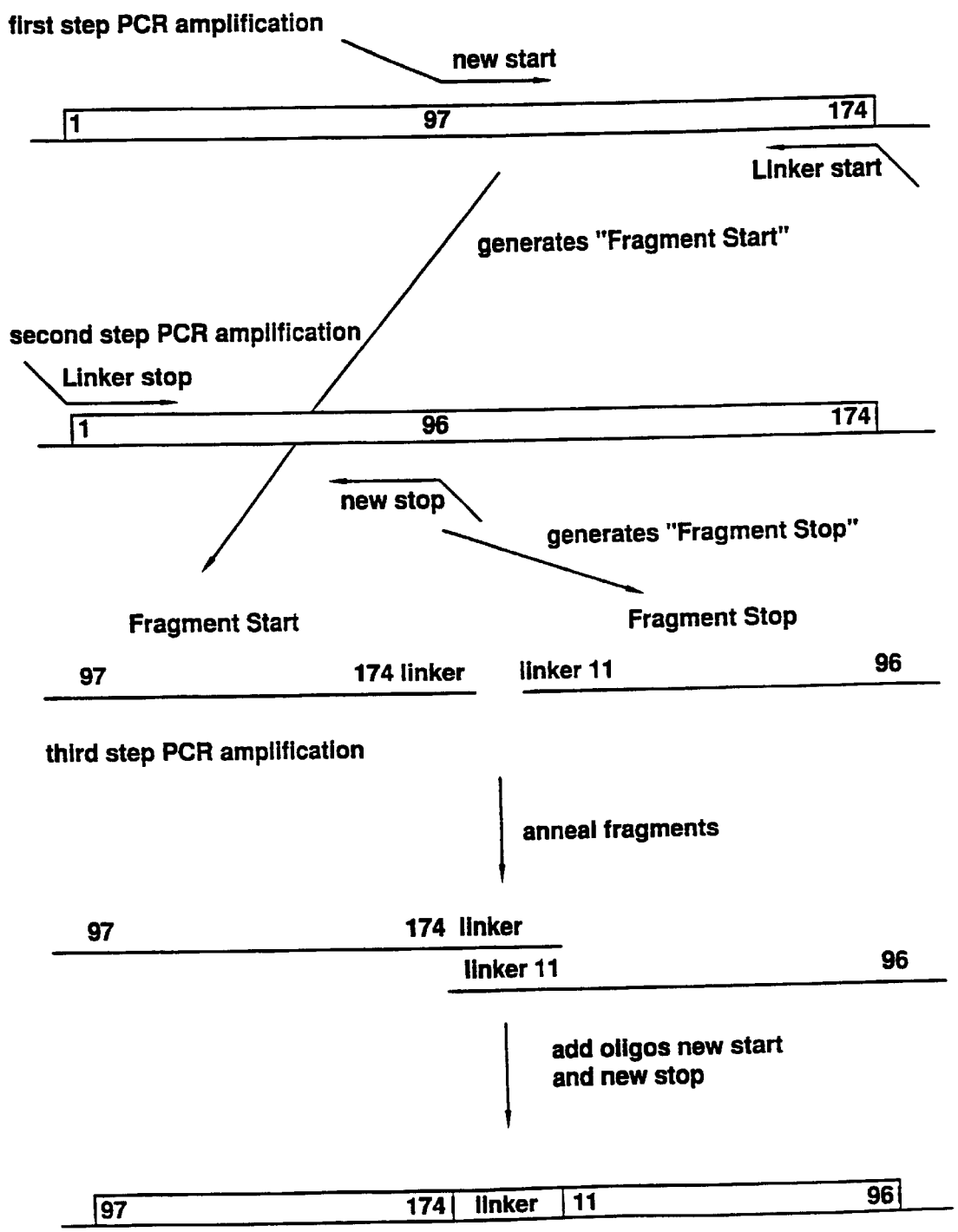
FIG. 2 shows a schematic of Method I, for creating new proteins in which the original N-terminus and C-terminus of the native protein are joined with a linker and different N-terminus and C-terminus of the protein are created. In the example shown the sequence rearrangement results in a new gene encoding a protein with a new N-terminus created at amino acid 97 of the original protein, the original C-terminus (a.a. 174) joined to the amino acid 11 (a.a. 1–10 are deleted) through a linker region and a new C-terminus created at amino acid 96 of the original sequence.

Genes with new N-terminus/C-terminus which contain a linker region ($L_2$) separating the original C-terminus and N-terminus can be made essentially following the method described in L. S. Mullins, et al *J. Am. Chem. Soc.* 116, 5529–5533, 1994). Multiple steps of polymerase chain reaction (PCR) amplifications are used to rearrange the DNA sequence encoding the primary amino acid sequence of the protein. The steps are illustrated in FIG. 2.

In the first step, the first primer set ("new start" and "linker start") is used to create and amplify, from the original gene sequence, the DNA fragment ("Fragment Start") that contains the sequence encoding the new N-terminal portion of the new protein followed by the linker ($L_2$) that connects the C-terminal and N-terminal ends of the original protein. In the second step, the second primer set ("new stop" and "linker stop") is used to create and amplify, from the original gene sequence, the DNA fragment ("Fragment Stop") that encodes the same linker as used above, followed by the new C-terminal portion of the new protein. The "new start" and "new stop" primers are designed to include the appropriate restriction sites which allow cloning of the new gene into expression plasmids. Typical PCR conditions are one cycle 95° C. melting for two minutes; 25 cycles 94° C. denaturation for one minute, 50° C. annealing for one minute and 72° C. extension for one minute; plus one cycle 72° C. extension for seven minutes. A Perkin Elmer GeneAmp PCR Core Reagents kit is used. A 100 ul reaction contains 100 pmole of each primer and one $\mu$g of template DNA; and 1×PCR buffer, 200 $\mu$M dGTP, 200 $\mu$M DATP, 200 $\mu$M dTTP, 200 $\mu$M dCTP, 2.5 units AmpliTaq DNA polymerase and 2 mM MgCl2. PCR reactions are performed in a Model 480 DNA thermal cycler (Perkin Elmer Corporation, Norwalk, Conn.).

"Fragment Start" and "Fragment Stop", which have complementary sequence in the linker region and the coding sequence for the two amino acids on both sides of the linker, are joined together in a third PCR step to make the full-length gene encoding the new protein. The DNA fragments "Fragment Start" and "Fragment Stop" are resolved on a 1% TAE gel, stained with ethidium bromide and isolated using a Qiaex Gel Extraction kit (Qiagen). These fragments are combined in equimolar quantities, heated at 70° C. for ten minutes and slow cooled to allow annealing through their shared sequence in "linker start" and "linker stop". In the third PCR step, primers "new start" and "new stop" are added to the annealed fragments to create and amplify the full-length new N-terminus/C-terminus gene. Typical PCR conditions are one cycle 95° C. melting for two minutes; 25 cycles 94° C. denaturation for one minute, 60° C. annealing for one minute and 72° C. extension for one minute; plus one cycle 72° C. extension for seven minutes. A Perkin Elmer GeneAmp PCR Core Reagents kit is used. A 100 ul reaction contains 100 pmole of each primer and approximately 0.5 $\mu$g of DNA; and 1×PCR buffer, 200 $\mu$M dGTP, 200 $\mu$M dATP, 200 $\mu$M dTTP, 200 $\mu$M dCTP, 2.5 units AmpliTaq DNA polymerase and 2 mM MgCl2. PCR reactions are purified using a Wizard PCR Preps kit (Promega).

Method II. Creation of Genes With New N-Terminus/C-terminus Without a Linker Region.

Figure 3:
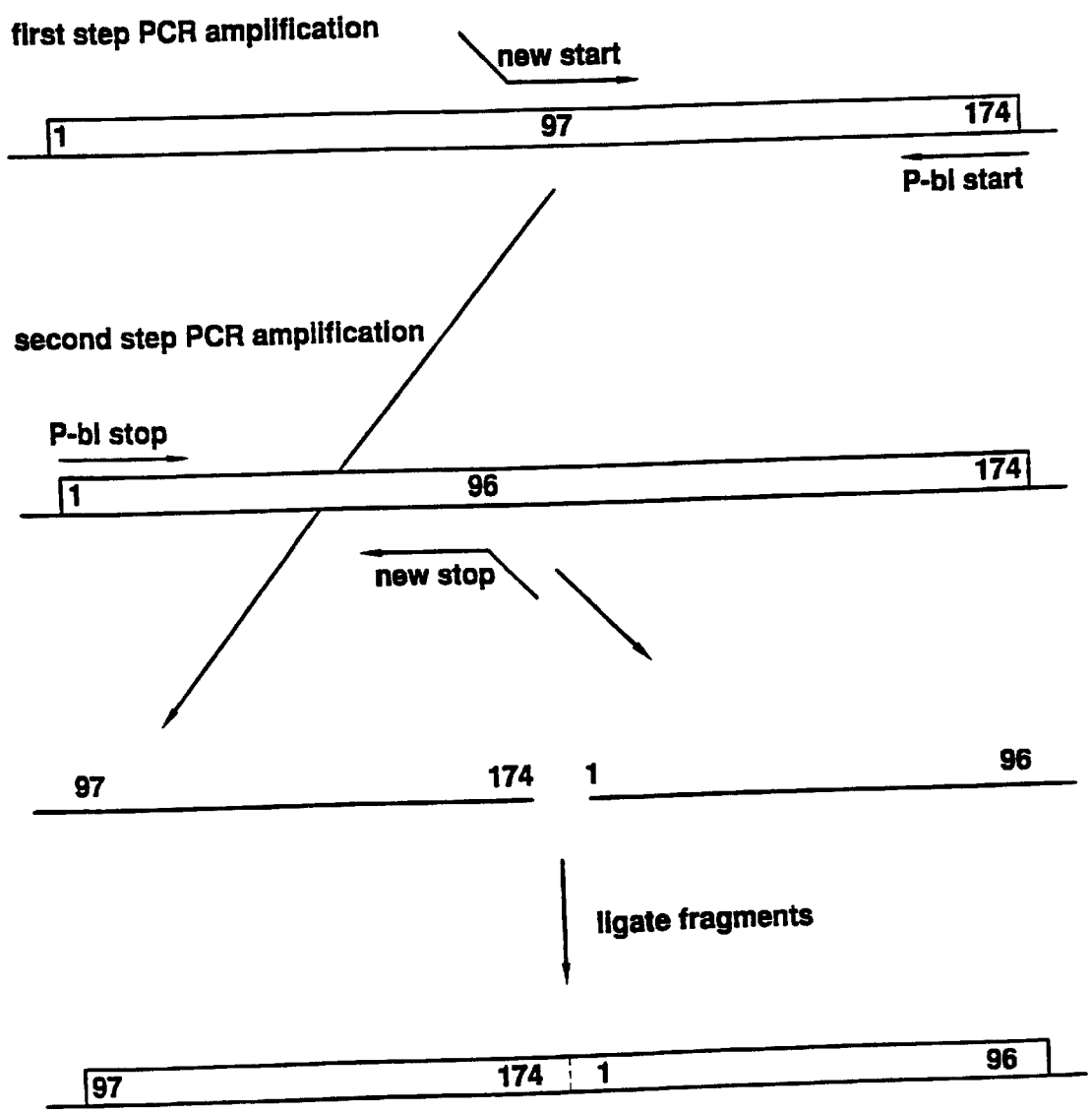
FIG. 3 shows a schematic of Method II, for creating new proteins in which the original N-terminus and C-terminus of the native protein are joined without a linker and different N-terminus and C-terminus of the protein are created. In the example shown the sequence rearrangement results in a new gene encoding a protein with a new N-terminus created at amino acid 97 of the original protein, the original C-terminus (a.a. 174) joined to the original N-terminus and a new C-terminus created at amino acid 96 of the original sequence.

New N-terminus/C-terminus genes without a linker joining the original N-terminus and C-terminus can be made using two steps of PCR amplification and a blunt end ligation. The steps are illustrated in FIG. 3. In the first step, the primer set ("new start" and "P-bl start") is used to create and amplify, from the original gene sequence, the DNA fragment ("Fragment Start") that contains the sequence encoding the new N-terminal portion of the new protein. In the second step, the primer set ("new stop" and "P-bl stop") is used to create and amplify, from gene sequence, the DNA fragment ("Fragment Stop") that contains the sequence encoding the new C-terminal portion of the new protein. The "new start" and "new stop" primers are designed to include appropriate restriction sites which allow cloning of the new gene into expression vectors. Typical PCR conditions are one cycle 95° C. melting for two minutes; 25 cycles 94° C. denaturation for one minute, 50° C. annealing for 45 seconds and 72° C. extension for 45 seconds. Deep Vent polymerase (New England Biolabs) is used to reduce the occurrence of overhangs in conditions recommended by the manufacturer. The "P-bl start" and "P-bl stop" primers are phosphorylated at the 5' end to aid in the subsequent blunt end ligation of "Fragment Start" and "Fragment Stop" to each other. A 100 ul reaction contained 150 pmole of each primer and one $\mu$g of template DNA; and 1×Vent buffer (New England Biolabs), 300 $\mu$M dGTP, 300 $\mu$M DATP, 300 $\mu$M dTTP, 300 $\mu$M dCTP, and 1 unit Deep Vent polymerase. PCR reactions are performed in a Model 480 DNA thermal cycler (Perkin Elmer Corporation, Norwalk, Conn.). PCR reaction products are purified using a Wizard PCR Preps kit (Promega).

The primers are designed to include appropriate restriction sites which allow for the cloning of the new gene into expression vectors. Typically "Fragment Start" is designed to create NcoI restriction site, and "Fragment Stop" is designed to create a HindIII restriction site. Restriction digest reactions are purified using a Magic DNA Clean-up System kit (Promega). Fragments Start and Stop are resolved on a 1% TAE gel, stained with ethidium bromide and isolated using a Qiaex Gel Extraction kit (Qiagen). These fragments are combined with and annealed to the ends of the ~3800 base pair NcoI/HindIII vector fragment of pMON3934 by heating at 50° C. for ten minutes and allowed to slow cool. The three fragments are ligated together using T4 DNA ligase (Boehringer Mannheim). The result is a plasmid containing the full-length new N-terminus/C-terminus gene. A portion of the ligation reaction is used to transform *E. coli* strain DH5a cells (Life Technologies, Gaithersburg, Md.). Plasmid DNA is purified and sequence confirmed as below.

Method III. Creation of New N-Terminus/C-terminus Genes By Tandem-duplication Method New N-terminus/C-terminus genes can be made based on the method described in R. A. Horlick, et al *Protein Eng.* 5:427–431, 1992). Polymerase chain reaction (PCR) amplification of the new N-terminus/C-terminus genes is performed using a tandemly duplicated template DNA. The steps are illustrated in FIG. 3.

The tandemly-duplicated template DNA is created by cloning and contains two copies of the gene separated by DNA sequence encoding a linker connecting the original C- and N-terminal ends of the two copies of the gene. Specific primer sets are used to create and amplify a full-length new N terminus/C-terminus gene from the tandemly-duplicated template DNA. These primers are designed to include appropriate restriction sites which allow for the cloning of the new gene into expression vectors. Typical PCR conditions are one cycle 95° C. melting for two minutes; 25 cycles 94° C. denaturation for one minute, 50° C. annealing for one minute and 72° C. extension for one minute; plus one cycle 72° C. extension for seven minutes. A Perkin Elmer Gene-Amp PCR Core Reagents kit (Perkin Elmer Corporation, Norwalk, Conn.) is used. A 100 ul reaction contains 100 pmole of each primer and one $\mu$g of template DNA; and 1×PCR buffer, 200 $\mu$M dGTP, 200 $\mu$M DATP, 200 $\mu$M dTTP, 200 $\mu$M dCTP, 2.5 units AmpliTaq DNA polymerase and 2 mM MgCl$_2$. PCR reactions are performed in a Model 480 DNA thermal cycler (Perkin Elmer Corporation, Norwalk, Conn.). PCR reactions are purified using a Wizard PCR Preps kit (Promega).

Cloning of New N-Terminus/C-terminus Genes into Multi-functional Receptor Agonist Expression Vectors The new N-terminus/C-terminus gene is digested with restriction endonucleases to create ends that are compatible to insertion into an expression vector containing another colony stimulating factor gene. This expression vector is likewise digested with restriction endonucleases to form compatible ends. After purification, the gene and the vector DNAs are combined and ligated using T4 DNA ligase. A portion of the ligation reaction is used to transform E. coli. Plasmid DNA is purified and sequenced to confirm the correct insert. The correct clones are grown for protein expression.

DNA Isolation and Characterization

Plasmid DNA can be isolated by a number of different methods and using commercially available kits known to those skilled in the art. A few such methods are shown herein. Plasmid DNA is isolated using the Promega Wizard™ Miniprep kit (Madison, Wis.), the Qiagen QIAwell Plasmid isolation kits (Chatsworth, Calif.) or Qiagen Plasmid Midi kit. These kits follow the same general procedure for plasmid DNA isolation. Briefly, cells are pelleted by centrifugation (5000×g), plasmid DNA released with sequential NaOH/acid treatment, and cellular debris is removed by centrifugation (10000×g). The supernatant (containing the plasmid DNA) is loaded onto a column containing a DNA-binding resin, the column is washed, and plasmid DNA eluted with TE. After screening for the colonies with the plasmid of interest, the *E. coli* cells are inoculated into 50–100 mls of LB plus appropriate antibiotic for overnight growth at 37° C. in an air incubator while shaking. The purified plasmid DNA is used for DNA sequencing, further restriction enzyme digestion, additional subcloning of DNA fragments and transfection into mammalian, *E. coli* or other cells.

Sequence Confirmation

Purified plasmid DNA is resuspended in $dH_2O$ and quantitated by measuring the absorbance at 260/280 nm in a Bausch and Lomb Spectronic 601 UV spectrometer. DNA samples are sequenced using ABI PRISM™ DyeDeoxy™ terminator sequencing chemistry (Applied Biosystems Division of Perkin Elmer Corporation, Lincoln City, Calif.) kits (Part Number 401388 or 402078) according to the manufacturers suggested protocol usually modified by the addition of 5% DMSO to the sequencing mixture. Sequencing reactions are performed in a Model 480 DNA thermal cycler (Perkin Elmer Corporation, Norwalk, Conn.) following the recommended amplification conditions. Samples are purified to remove excess dye terminators with Centri-Sep™ spin columns (Princeton Separations, Adelphia, N.J.) and lyophilized. Fluorescent dye labeled sequencing reactions are resuspended in deionized formamide, and sequenced on denaturing 4.75% polyacrylamide-8M urea gels using an ABI Model 373A automated DNA sequencer. Overlapping DNA sequence fragments are analyzed and assembled into master DNA contigs using Sequencher v2.1 DNA analysis software (Gene Codes Corporation, Ann Arbor, Mich.).

Expression of Multi-functional Receptor Agonists in Mammalian Cells

Mammalian Cell Transfection/production of Conditioned Media

The BHK-21 cell line can be obtained from the ATCC (Rockville, Md.). The cells are cultured in Dulbecco's modified Eagle media (DMEM/high-glucose), supplemented to 2 mM (mM) L-glutamine and 10% fetal bovine serum (FBS). This formulation is designated BHK growth media. Selective media is BHK growth media supplemented with 453 units/mL hygromycin B (Calbiochem, San Diego, Calif.). The BHK-21 cell line was previously stably transfected with the HSV transactivating protein VP16, which transactivates the IE110 promoter found on the plasmid pMON3359 (See Hippenmeyer et al., *Bio/Technology*, pp.1037–1041, 1993). The VP16 protein drives expression of genes inserted behind the IE110 promoter. BHK-21 cells expressing the transactivating protein VP16 are designated BHK-VP16. The plasmid pMON1118 (See Highkin et al., *Poultry Sci*., 70: 970–981, 1991) expresses the hygromycin resistance gene from the SV40 promoter. A similar plasmid is available from ATCC, pSV2-hph.

BHK-VP16 cells are seeded into a 60 millimeter (mm) tissue culture dish at $3\times10^5$ cells per dish 24 hours prior to transfection. Cells are transfected for 16 hours in 3 mL of "OPTIMEM"™ (Gibco-BRL, Gaithersburg, Md.) containing 10 μg of plasmid DNA containing the gene of interest, 3 μg hygromycin resistance plasmid, pMON1118, and 80 μg of Gibco-BRL "LIPOFECTAMINE"™ per dish. The media is subsequently aspirated and replaced with 3 mL of growth media. At 48 hours post-transfection, media from each dish is collected and assayed for activity (transient conditioned media). The cells are removed from the dish by trypsin-EDTA, diluted 1:10 and transferred to 100 mm tissue culture dishes containing lb mL of selective media. After approximately 7 days in selective media, resistant cells grow into colonies several millimeters in diameter. The colonies are removed from the dish with filter paper (cut to approximately the same size as the colonies and soaked in trypsin/EDTA) and transferred to individual wells of a 24 well plate containing 1 mL of selective media. After the clones are grown to confluence, the conditioned media is re-assayed, and positive clones are expanded into growth media.

Expression of Multi-functional Receptor Agonists in *E. coli*

*E. coli* strain MON105 or JM101 harboring the plasmid of interest are grown at 37° C. in M9 plus casamino acids medium with shaking in a air incubator Model G25 from New Brunswick Scientific (Edison, N.J.). Growth is monitored at OD600 until it reaches a value of 1.0 at which time Nalidixic acid (10 milligrams/mL) in 0.1 N NaOH is added to a final concentration of 50 μg/mL. The cultures are then shaken at 37° C. for three to four additional hours. A high degree of aeration is maintained throughout culture period in order to achieve maximal production of the desired gene product. The cells are examined under a light microscope for the presence of inclusion bodies (IB). One mL aliquots of the culture are removed for analysis of protein content by boiling the pelleted cells, treating them with reducing buffer and electrophoresis via SDS-PAGE (see Maniatis et al. Molecular Cloning: A Laboratory Manual, 1982). The culture is centrifuged (5000×g) to pellet the cells.

Inclusion Body Preparation, Extraction, Refolding, Dialysis, DEAE Chromatography, and Characterization of the Multi-functional Hematopoietic Receptor Agonists Which Accumulate as Inclusion Bodies in *E. coli*

Isolation of Inclusion Bodies:

The cell pellet from a 330 mL *E. coli* culture is resuspended in 15 mL of sonication buffer (10 mM 2-amino-2-(hydroxymethyl) 1,3-propanediol hydrochloride (Tris-HCl), pH 8.0 mM ethylenediaminetetraacetic acid (EDTA). These resuspended cells are sonicated using the microtip probe of a Sonicator Cell Disruptor (Model W-375, Heat Systems-Ultrasonics, Inc., Farmingdale, N.Y.). Three rounds of sonication in sonication buffer followed by centrifugation are employed to disrupt the cells and wash the inclusion bodies (IB). The first round of sonication is a 3 minute burst followed by a 1 minute burst, and the final two rounds of sonication are for 1 minute each.

Extraction and Refolding of Proteins From Inclusion Body Pellets:

Following the final centrifugation step, the IB pellet is resuspended in 10 mL of 50 mM Tris-HCl, pH 9.5, 8 M urea and 5 mM dithiothreitol (DTT) and stirred at room temperature for approximately 45 minutes to allow for denaturation of the expressed protein.

The extraction solution is transferred to a beaker containing 70 mL of 5 mM Tris-HCl, pH 9.5 and 2.3 M urea and gently stirred while exposed to air at 4° C. for 18 to 48 hours to allow the proteins to refold. Refolding is monitored by analysis on a Vydac (Hesperia, Calif.) $C_{18}$ reversed phase high pressure liquid chromatography (RP-HPLC) column (0.46×25 cm). A linear gradient of 40% to 65% acetonitrile, containing 0.1% trifluoroacetic acid (TFA), is employed to monitor the refold. This gradient is developed over 30 minutes at a flow rate of 1.5 mL per minute. Denatured proteins generally elute later in the gradient than the refolded proteins.

Purification:

Following the refold, contaminating E. coli proteins are removed by acid precipitation. The pH of the refold solution is titrated to between pH 5.0 and pH 5.2 using 15% (v/v) acetic acid (HOAc). This solution is stirred at 4° C. for 2 hours and then centrifuged for 20 minutes at 12,000×g to pellet any insoluble protein.

The supernatant from the acid precipitation step is dialyzed using a Spectra/Por 3 membrane with a molecular weight cut off (MWCO) of 3,500 daltons. The dialysis is against 2 changes of 4 liters (a 50-fold excess) of 10 mM Tris-HCl, pH 8.0 for a total of 18 hours. Dialysis lowers the sample conductivity and removes urea prior to DEAE chromatography. The sample is then centrifuged (20 minutes at 12,000×g) to pellet any insoluble protein following dialysis.

A Bio-Rad Bio-Scale DEAE2 column (7×52 mm) is used for ion exchange chromatography. The column is equilibrated in a buffer containing 10 mM Tris-HCl, pH 8.0, and a 0-to-500 mM sodium chloride (NaCl) gradient, in equilibration buffer, over 45 column volumes is used to elute the protein. A flow rate of 1.0 mL per minute is used throughout the run. Column fractions (2.0 mL per fraction) are collected across the gradient and analyzed by RP HPLC on a Vydac (Hesperia, Ca.) C18 column (0.46×25 cm). A linear gradient of 40% to 65% acetonitrile, containing 0.1% trifluoroacetic acid (TFA), is employed. This gradient is developed over 30 minutes at a flow rate of 1.5 mL per minute. Pooled fractions are then dialyzed against 2 changes of 4 liters (50-to-500-fold excess) of 10 mM ammonium acetate (NH4Ac), pH 4.0 for a total of 18 hours. Dialysis is performed using a Spectra/Por 3 membrane with a MWCO of 3,500 daltons. Finally, the sample is sterile filtered using a 0.22 µm syringe filter (uStar LB syringe filter, Costar, Cambridge, Mass.), and stored at 4° C.

In some cases the folded proteins can be affinity purified using affinity reagents such as mAbs or receptor subunits attached to a suitable matrix. Alternatively, (or in addition) purification can be accomplished using any of a variety of chromatographic methods such as: ion exchange, gel filtration or hydrophobic chromatography or reversed phase HPLC.

These and other protein purification methods are described in detail in Methods in Enzymology, Volume 182 'Guide to Protein Purification' edited by Murray Deutscher, Academic Press, San Diego, Calif. (1990).

Protein Characterization:

The purified protein is analyzed by RP-HPLC, electrospray mass spectrometry, and SDS-PAGE. The protein quantitation is done by amino acid composition, RP-HPLC, and Bradford protein determination. In some cases tryptic peptide mapping is performed in conjunction with electrospray mass spectrometry to confirm the identity of the protein.

AML Proliferation Assay for Bioactive Human Interleukin-3

The factor-dependent cell line AML 193 was obtained from the American Type Culture Collection (ATCC, Rockville, Md.). This cell line, established from a patient with acute myelogenous leukemia, is a growth factor dependent cell line which displayed enhanced growth in GM-CSF supplemented medium (Lange, B., et al., Blood 70: 192, 1987; Valtieri, M., et al., J. Immunol. 138:4042, 1987). The ability of AML 193 cells to proliferate in the presence of human IL-3 has also been documented. (Santoli, D., et al., J. Immunol. 139: 348, 1987). A cell line variant was used, AML 193 1.3, which was adapted for long term growth in IL-3 by washing out the growth factors and starving the cytokine dependent AML 193 cells for growth factors for 24 hours. The cells are then replated at $1 \times 10^5$ cells/well in a 24 well plate in media containing 100 U/mL IL-3. It took approximately 2 months for the cells to grow rapidly in IL-3. These cells are maintained as AML 193 1.3 thereafter by supplementing tissue culture medium (see below) with human IL-3.

AML 193 1.3 cells are washed 6 times in cold Hanks balanced salt solution (HBSS, Gibco, Grand Island, N.Y.) by centrifuging cell suspensions at 250×g for 10 minutes followed by decantation of the supernatant. Pelleted cells are resuspended in HBSS and the procedure is repeated until six wash cycles are completed. Cells washed six times by this procedure are resuspended in tissue culture medium at a density ranging from $2 \times 10^5$ to $5 \times 10^5$ viable cells/mL. This medium is prepared by supplementing Iscove's modified Dulbecco's Medium (IMDM, Hazelton, Lenexa, Kans.) with albumin, transferrin, lipids and 2-mercaptoethanol. Bovine albumin (Boehringer-Mannheim, Indianapolis, Ind.) is added at 500 µg/mL; human transferrin (Boehringer-Mannheim, Indianapolis, Ind.) is added at 100 µg/mL; soybean lipid .(Boehringer-Mannheim, Indianapolis, Ind.) is added at 50 µg/mL; and 2-mercaptoethanol (Sigma, St. Louis, Mo.) is added at $5 \times 10^{-5}$ M.

Serial dilutions of human interleukin-3 or multi-functional hematopoietic receptor agonist proteins are made in triplicate series in tissue culture medium supplemented as stated above in 96 well Costar 3596 tissue culture plates. Each well contained 50 µl of medium containing interleukin-3 or multi-functional hematopoietic receptor agonist proteins once serial dilutions are completed. Control wells contained tissue culture medium alone (negative control). AML 193 1.3 cell suspensions prepared as above are added to each well by pipetting 50 µl ($2.5 \times 10^4$ cells) into each well. Tissue culture plates are incubated at 37° C. with 5% $CO_2$ in humidified air for 3 days. On day 3, 0.5 µCi $^3$H-thymidine (2 Ci/mM, New England Nuclear, Boston, Mass.) is added in 50 µl of tissue culture medium. Cultures are incubated at 37° C. with 5% $CO_2$ in humidified air for 18–24 hours. Cellular DNA is harvested onto glass filter mats (Pharmacia LKB, Gaithersburg, Md.) using a TOMTEC cell harvester (TOMTEC, Orange, Conn.) which utilized a water wash cycle followed by a 70% ethanol wash cycle. Filter mats are allowed to air dry and then placed into sample bags to which scintillation fluid (Scintiverse II, Fisher Scientific, St. Louis, Mo. or BetaPlate Scintillation Fluid, Pharmacia LKB, Gaithersburg, Md.) is added. Beta emissions of samples from individual tissue culture wells are counted in a LKB BetaPlate model 1205 scintillation counter (Pharmacia LKB, Gaithersburg, Md.) and data is expressed as counts per minute of $^3$H-thymidine incorporated into cells from each tissue culture well. Activity of each human interleukin-3 preparation or multi-functional hematopoietic receptor agonist protein preparation is quantitated by measuring cell proliferation ($^3$H-thymidine incorporation) induced by graded concentrations of interleukin-3 or multi-functional hematopoietic receptor agonist. Typically, concentration ranges from 0.05 pM–$10^5$ pM are quantitated in these assays. Activity is determined by measuring the dose of interleukin-3 or multi-functional hematopoietic receptor agonist protein which provides 50% of maximal proliferation ($EC_{50}$=0.5×(maximum average counts per minute of $^3$H-thymidine incorporated per well among triplicate cultures of all concentrations of interleukin-3 tested—background proliferation measured by $^3$H-thymidine incorporation observed in triplicate cultures lacking interleukin-3). This ECSO value is also equivalent to 1 unit of bioactivity. Every assay is performed with native interleukin-3 as a reference standard so that relative activity levels could be assigned.

Typically, the multi-functional hematopoietic receptor agonist proteins were tested in a concentration range of 2000 pM to 0.06 pM titrated in serial 2 fold dilutions.

Activity for each sample was determined by the concentration which gave 50% of the maximal response by fitting a four-parameter logistic model to the data. It was observed that the upper plateau (maximal response) for the sample and the standard with which it was compared did not differ. Therefore relative potency calculation for each sample was determined from EC50 estimations for the sample and the standard as indicated above. AML 193.1.3 cells proliferate in response to hIL-3, hGM-CSF and hG-CSF. Therefore the following additional assays were performed for some samples to demonstrate that the G-CSF receptor agonist portion of the multi-functional hematopoietic receptor agonist proteins was active. The proliferation assay was performed with the multi-functional hematopoietic receptor agonist plus and minus neutralizing monoclonal antibodies to the hIL-3 receptor agonist portion. In addition, a fusion molecule with the factor Xa cleavage site was cleaved then purified and the halves of the molecule were assayed for proliferative activity. These experiments showed that both components of the multi-functional hematopoietic receptor agonist proteins were active.

TF1 c-mpl Ligand Dependent Proliferation Assay

The c-mpl ligand proliferative activity can be assayed using a subclone of the pluripotential human cell line TF1 (Kitamura et al., *J. Cell Physiol* 140:323–334. [1989]). TF1 cells are maintained in h-$IL_3$ (100 U/mL). To establish a sub-clone responsive to c-mpl ligand, cells are maintained in passage media containing 10% supernatant from BHK cells transfected with the gene expressing the 1–153 form of c-mpl ligand (pMON26448). Most of the cells die, but a subset of cells survive. After dilution cloning, a c-mpl ligand responsive clone is selected, and these cells are split into passage media to a density of 0.3×$10^6$ cells/mL the day prior to assay set-up. Passage media for these cells is the following: RPMI 1640 (Gibco), 10% FBS (Harlan, Lot #91206), 10% c-mpl ligand supernatant from transfected BHK cells, 1 mM sodium pyruvate (Gibco), 2 mM glutamine (Gibco), and 100 μg/mL penicillin-streptomycin (Gibco). The next day, cells are harvested and washed twice in RPMI or IMDM media with a final wash in the ATL, or assay media. ATL medium consists of the following:IMDM (Gibco), 500 μg/mL of bovine serum albumin, 100 μg/mL of human transferrin, 50 μg/mL soybean lipids, 4×10−8M beta-mercaptoethanol and 2 mL of A9909 (Sigma, antibiotic solution) per 1000 mL of ATL. Cells are diluted in assay media to a final density of 0.25×$10^6$ cells/mL in a 96-well low evaporation plate (Costar) to a final volume of 50 ul. Transient supernatants (conditioned media) from transfected clones are added at a volume of 50 ul as duplicate samples at a final concentration of 50% and diluted three-fold to a final dilution of 1.8%. Triplicate samples of a dose curve of IL-3 variant pMON13288 starting at 1 ng/mL and diluted using three-fold dilutions to 0.0014 ng/mL is included as a positive control. Plates are incubated at 5% $CO_2$ and 37° C. At day six of culture, the plate is pulsed with 0.5 Ci of 3H/well (NEN) in a volume of 20 ul/well and allowed to incubate at 5% $CO_2$ and 37° C. for four hours. The plate is harvested and counted on a Betaplate counter.

Other in vitro Cell Based Proliferation Assays

Other in vitro cell based assays, known to those skilled in the art, may also be useful to determine the activity of the multi-functional hematopoietic receptor agonists depending on the factors that comprise the molecule in a similar manner as described in the AML 193.1.3 cell proliferation assay. The following are examples of other useful assays.

TF1 proliferation assay: TF1 is a pluripotential human cell line (Kitamura et al., J. Cell Physiol 140:323–334. [1989]) that responds to hIL-3.

32D proliferation assay: 32D is a murine IL-3 dependent cell line which does not respond to human IL-3 but does respond to human G-CSF which is not species restricted.

Baf/3 proliferation assay: Baf/3 is a murine IL-3 dependent cell line which does not respond to human IL-3 or human c-mpl ligand but does respond to human G-CSF which is not species restricted.

T1165 proliferation assay: T1165 cells are a IL-6 dependent murine cell line (Nordan et al., 1986) which respond to IL-6 and IL-11.

Human Plasma Clot meg-CSF Assay: Used to assay megakaryocyte colony formation activity (Mazur et al., 1981).

Transfected Cell Lines

Cell lines such as the murine Baf/3 cell line can be transfected with a colony stimulating factor receptor, such as the human G-CSF receptor or human c-mpl receptor, which the cell line does not have. These transfected cell lines can be used to determine the activity of the ligand for which the receptor has been transfected into the cell line.

One such transfected Baf/3 cell line was made by cloning the cDNA encoding c-mpl from a library made from a c-mpl responsive cell line and cloned into the multiple cloning site of the plasmid pcDNA3 (Invitrogen, San Diego Calif.). Baf/3 cells were transfected with the plasmid via electroporation. The cells were grown under G418 selection in the presence of mouse IL-3 in Wehi conditioned media. Clones were established through limited dilution.

In a similar manner the human G-CSF receptor can be transfected into the Baf/3 cell line and used to determine the bioactivity of the multi-functional hematopoietic receptor agonists.

Analysis of c-mpl Ligand Proliferative Activity
Methods
. Bone Marrow Proliferation Assay
a. CD34+ Cell Purification:

Bone marrow aspirates (15–20 mL) were obtained from normal allogeneic marrow donors after informed consent. Cells were diluted 1:3 in phosphate buffered saline (PBS, Gibco-BRL), 30 mL were layered over 15 mL Histopaque-1077 (Sigma) and centrifuged for 30 minutes at 300 RCF. The mononuclear interface layer was collected and washed in PBS. CD34+ cells were enriched from the mononuclear cell preparation using an affinity column per manufacturers instructions (CellPro, Inc, Bothell Wash.). After enrichment, the purity of CD34+ cells was 70% on average as determined by using flow cytometric analysis using anti-CD34 monoclonal antibody conjugated to fluorescein and anti-CD38 conjugated to phycoerythrin (Becton Dickinson, San Jose Calif.).

Cells were resuspended at 40,000 cells/mL in X-Vivo 10 media (Bio-Whittaker, Walkersville, Md.) and 1 mL was plated in 12-well tissue culture plates (Costar). The growth factor rhIL-3 was added at 100 ng/mL (pMON5873) was added to some wells. $hIL_3$ variants were used at 10 ng/mL to 100 ng/mL. Conditioned media from BHK cells transfected with plasmid encoding c-mpl ligand or multi-functional hematopoietic receptor agonists were tested by addition of 100 µl of supernatant added to 1 mL cultures (approximately a 10% dilution). Cells were incubated at 37° C. for 8–14 days at 5% $CO_2$ in a 37° C. humidified incubator.
b. Cell Harvest and Analysis:

At the end of the culture period a total cell count was obtained for each condition. For fluorescence analysis and ploidy determination cells were washed in megakaryocyte buffer (MK buffer, 13.6 mM sodium citrate, 1 mM theophylline, 2.2 µm PGE1, 11 mM glucose, 3% w/v BSA, in PBS, pH 7.4,) (Tomer et al., *Blood* 70: 1735–1742, 1987) resuspended in 500 µl of MK buffer containing anti-CD41a FITC antibody (1:200, AMAC, Westbrook, Me.) and washed in MK buffer. For DNA analysis cells were permeablized in MK buffer containing 0.5% Tween 20 (Fisher, Fair Lawn N.J.) for 20 min. on ice followed by fixation in 0.5% Tween-20 and 1% paraformaldehyde (Fisher Chemical) for 30 minutes followed by incubation in propidium iodide (Calbiochem La Jolla Calif.) (50 µg/mL) with RNA-ase (400 U/mL) in 55% v/v MK buffer (200mOsm) for 1–2 hours on ice. Cells were analyzed on a FACScan or Vantage flow cytometer (Becton Dickinson, San Jose, Calif.). Green fluorescence (CD41a-FITC) was collected along with linear and log signals for red fluorescence (PI) to determine DNA ploidy. All cells were collected to determine the percent of cells that were CD41+. Data analysis was performed using software by LYSIS (Becton Dickinson, San Jose, Calif.). Percent of cells expressing the CD41 antigen was obtained from flow cytometry analysis(Percent). Absolute (Abs) number of CD41+ cells/mL was calculated by: (Abs)=(Cell Count)*(Percent)/100.

. Megakaryocyte Fibrin Clot Assay.

CD34+ enriched population were isolated as described above. Cells were suspended at 25,000 cells/mL with or without cytokine(s) in a media consisting of a base Iscoves IMDM media supplemented with 0.3% BSA, 0.4 mg/mL apo-transferrin, 6.67 µM $FeCl_2$, 25 µg/mL $CaCl_2$, 25 µg/mL L-asparagine, 500 µg/mL e-amino-n-caproic acid and penicillin/streptomycin. Prior to plating into 35 mm plates, thrombin was added (0.25 Units/mL) to initiate clot formation. Cells were incubated at 37° C. for 13 days at 5% $CO_2$ in a 37° C. humidified incubator.

At the end of the culture period plates were fixed with methanol:acetone (1:3), air dried and stored at −200 C until staining. A peroxidase immunocytochemistry staining procedure was used (Zymed, Histostain-SP. San Francisco, Calif.) using a cocktail of primary monoclonal antibodies consisting of anti-CD41a, CD42 and CD61. Colonies were counted after staining and classified as negative, CFU-MK (small colonies, 1–2 foci and less that approx. 25 cells), BFU-MK (large, multi-foci colonies with >25 cells) or mixed colonies (mixture of both positive and negative cells.

Methylcellulose Assay

This assay reflects the ability of colony stimulating factors to stimulate normal bone marrow cells to produce different types of hematopoietic colonies in vitro (Bradley et al.,*Aust. Exp Biol. Sci.* 44:287–300, 1966), Pluznik et al., *J. Cell Comp. Physio* 66:319–324, 1965).
Methods Approximately 30 mL of fresh, normal, healthy bone marrow aspirate are obtained from individuals following informed consent. Under sterile conditions samples are diluted 1:5 with a 1×PBS (#14040.059 Life Technologies, Gaithersburg, Md.) solution in a 50 mL conical tube (#25339-50 Corning, Corning Md.). Ficoll (Histopaque 1077 Sigma H-8889) is layered under the diluted sample and centrifuged, 300×g for 30 min. The mononuclear cell band is removed and washed two times in 1×PBS and once with 1% BSA PBS (CellPro Co., Bothel, Wash.). Mononuclear cells are counted and CD34+ cells are selected using the Ceprate LC (CD34) Kit (CellPro Co., Bothel, Wash.) column. This fractionation is performed since all stem and progenitor cells within the bone marrow display CD34 surface antigen.

Cultures are set up in triplicate with a final volume of 1.0 mL in a 35×10 mm petri dish (Nunc#174926). Culture medium is purchased from Terry Fox Labs. (HCC-4230 medium (Terry Fox Labs, Vancouver, B.C., Canada) and erythropoietin (Amgen, Thousand Oaks, Calif.) is added to the culture media. 3,000–10,000 CD34+ cells are added per dish. Recombinant IL-3, purified from mammalian cells or *E. coli*, and multi-functional hematopoietic receptor agonist proteins, in conditioned media from transfected mammalian cells or purified from conditioned media from transfected mammalian cells or *E. coli*, are added to give final concentrations ranging from 0.001 nM to 10 nM. Recombinant hIL-3, GM-CSF, c-mpl ligand and multi-functional hematopoietic receptor agonist are supplied in house. G-CSF (Neupogen) is from Amgen (Thousand Oaks Calf.). Cultures are resuspended using a 3 cc syringe and 1.0 mL is dispensed per dish. Control (baseline response) cultures received no colony stimulating factors. Positive control cultures received conditioned media (PHA stimulated human cells: Terry Fox Lab. H2400). Cultures are incubated at 37° C., 5% $CO_2$ in humidified air.

Hematopoietic colonies which are defined as greater than 50 cells are counted on the day of peak response (days 10–11) using a Nikon inverted phase microscope with a 40× objective combination. Groups of cells containing fewer than 50 cells are referred to as clusters. Alternatively colonies can be identified by spreading the colonies on a slide and stained or they can be picked, resuspended and spun onto cytospin slides for staining.

Human Cord Blood Hematopoietic Growth Factor Assays

Bone marrow cells are traditionally used for in vitro assays of hematopoietic colony stimulating factor (CSF)

activity. However, human bone marrow is not always available, and there is considerable variability between donors. Umbilical cord blood is comparable to bone marrow as a source of hematopoietic stem cells and progenitors (Broxmeyer et al., *PNAS USA* 89:4109–113, 1992; Mayani et al., *Blood* 81:3252–3258, 1993). In contrast to bone marrow, cord blood is more readily available on a regular basis. There is also a potential to reduce assay variability by pooling cells obtained fresh from several donors, or to create a bank of cryopreserved cells for this purpose. By modifying the culture conditions, and/or analyzing for lineage specific markers, it is be possible to assay specifically for granulocyte/macrophage colonies (CFU-GM), for megakaryocyte CSF activity, or for high proliferative potential colony forming cell (HPP-CFC) activity.

Methods

Mononuclear cells (MNC) are isolated from cord blood within 24 hr. of collection, using a standard density gradient (1.077 g/mL Histopaque). Cord blood MNC have been further enriched for stem cells and progenitors by several procedures, including immunomagnetic selection for CD14−, CD34+ cells; panning for SBA−, CD34+ fraction using coated flasks from Applied Immune Science (Santa Clara, Calif.); and CD34+ selection using a CellPro (Bothell, Wash.) avidin column. Either freshly isolated or cryopreserved CD34+ cell enriched fractions are used for the assay. Duplicate cultures for each serial dilution of sample (concentration range from 1 pM to 1204 pM) are prepared with 1×104 cells in 1ml of 0.9% methycellulose containing medium without additional growth factors (Methocult H4230 from Stem Cell Technologies, Vancouver, BC.). In some experiments, Methocult H4330 containing erythropoietin (EPO) was used instead of Methocult H4230, or Stem Cell Factor (SCF), 50 ng/mL (Biosource International, Camarillo, Calif.) was added. After culturing for 7–9 days, colonies containing >30 cells are counted. In order to rule out subjective bias in scoring, assays are scored blind.

Additional details about recombinant DNA methods which may be used to create the variants, express them in bacteria, mammalian cells or insect cells, purification and refold of the desired proteins and assays for determining the bioactivity of the proteins may be found in co-filed Applications WO 95/00646, WO 94/12639, WO 94/12638, WO 95/20976, WO 95/21197, WO 95/20977, WO 95/21254 and U.S. Ser. No. 08/383,035 which are hereby incorporated by reference in their entirety.

Further details known to those skilled in the art may be found in T. Maniatis, et al., *Molecular Cloning, A Laboratory Manual*, Cold Spring Harbor Laboratory, 1982) and references cited therein, incorporated herein by reference; and in J. Sambrook, et al., *Molecular Cloning, A Laboratory Manual*, 2nd edition, Cold Spring Harbor Laboratory, 1989) and references cited therein, are incorporated herein by reference.

TABLE 1

| OLIGONUCLEOTIDES | |
|---|---|
| c-mp1NcoI<br><br>N = A,C,G or T | ACGTCCATGGCNTCNCCNGCNCCNCCTGCTTGTGCACTCCGAGTC (SEQ ID NO:13) |
| Ecomp1 | ATGCACGAATTCCCTGACGCAGAGGGTGGA (SEQ ID NO:14) |
| c-mp1HindIII | TGACAAGCTTACCTGACGCAGAGGGTGGACCCT (SEQ ID NO:15) |
| 4L-5' | AATTCGGCAA (SEQ ID NO:16) |
| 4L-3' | CATGTTGCCG (SEQ ID NO:17) |
| 5L-5' | AATTCGGCGGCAA (SEQ ID NO:18) |
| 5L-3' | CATGTTGCCGCCG (SEQ ID NO:19) |
| 8L-5' | AATTCGGCGGCAACGGCGGCAA (SEQ ID NO:20) |
| 8L-3' | CATGTTGCCGCCGTTGCCGCCG (SEQ ID NO:21) |
| 31-5' | CGATCCATGGAGGTTCACCCTTTGCCT (SEQ ID NO:22) |
| 31-3' | GATCAAGCTTATGGGCACTGGCTCAGTCT (SEQ ID NO:23) |
| 35-5' | CGATACATGTTGCCTACACCTGTCCTG (SEQ ID NO:24) |
| 35-3' | GATCAAGCTTAAGGGTGAACCTCTGGGCA (SEQ ID NO:25) |
| 39-5' | CGATCCATGGTCCTGCTGCCTGCTGTG (SEQ ID NO:26) |
| 39-3' | GATCAAGCTTAAGGTGTAGGCAAAGGGTG (SEQ ID NO:27) |
| 43-5' | CGATCCATGGCTGTGGACTTTAGCTTGGGA (SEQ ID NO:28) |
| 43-3' | GATCAAGCTTAAGGCAGCAGGACAGGTGT (SEQ ID NO:29) |
| 45-5' | CGATCCATGGACTTTAGCTTGGGAGAA (SEQ ID NO:30) |
| 45-3' | GATCAAGCTTACACAGCAGGCAGCAGGAC (SEQ ID NO:31) |

TABLE 1-continued

OLIGONUCLEOTIDES

| | |
|---|---|
| 49-5' | CGATCCATGGGAGAATGGAAAACCCAG (SEQ ID NO:32) |
| 49-3' | GATCAAGCTTACAAGCTAAAGTCCACAGC (SEQ ID NO:33) |
| 82-5' | CGATCCATGGGACCCACTTGCCTCTCA (SEQ ID NO:34) |
| 82-3' | GATCAAGCTTACAGTTGTCCCCGTGCTGC (SEQ ID NO:35) |
| 109-5' | CAGTCCATGGGAACCCAGCTTCCTCCA (SEQ ID NO:36) |
| 109-3' | GATCAAGCTTAAAGGAGGCTCTGCAGGGC (SEQ ID NO:37) |
| 116-5' | CGATCCATGGGCAGGACCACAGCTCAC (SEQ ID NO:38) |
| 116-3' | GATCAAGCTTACTGTGGAGGAAGCTGGGTT (SEQ ID NO:39) |
| 120-5' | CGATCCATGGCTCACAAGGATCCCAATGCC (SEQ ID NO:40) |
| 120-3' | GATCAAGCTTATGTGGTCCTGCCCTGTGG (SEQ ID NO:41) |
| 123-5' | CGATCCATGGATCCCAATGCCATCTTCCTG (SEQ ID NO:42) |
| 123-3' | GATCAAGCTTACTTGTGAGCTGTGGTCCT (SEQ ID NO:43) |
| 126-5' | CGATCCATGGCCATCTTCCTGAGCTTCCAA (SEQ ID NO:44) |
| 126-3' | GATCAAGCTTAATTGGGATCCTTGTGAGCTGT (SEQ ID NO:45) |
| SYNNOXA1.REQ | AATTCCGTCG TAAACTGACC TTCTATCTGA AAACCTTGGA GAACGCGCAG GCTCAACAGT ACGTAGAGGG CGGTGGAGGC TCC (SEQ ID NO:46) |
| SYNNOXA2.REQ | CCGGGGAGCC TCCACCGCCC TCTACGTACT GTTGAGCCTG CGCGTTCTCC AAGGTTTTCA GATAGAAGGT CAGTTTACGA CGG (SEQ ID NO:47) |
| L1syn.for | GTTACCCTTG AGCAAGCGCA GGAACAACAG GGTGGTGGCT CTAACTGCTC TATAATGAT (SEQ ID NO:48) |
| L1syn.rev | CGATCATTAT AGAGCAGTTA GAGCCACCAC CCTGTTGTTC CTGCGCTTGC TCAAGG (SEQ ID NO:49) |
| L3syn.for | GTTACCCTTG AGCAAGCGCA GGAACAACAG GGTGGTGGCT CTGGCGGTGG CAGCGGCGGC GGTTCTAACT GCTCTATAAT GAT (SEQ ID NO:50) |
| L3syn.rev | CGATCATTAT AGAGCAGTTA GAACCGCCGC CGCTGCCACC GCCAGAGCCA CCACCCTGTT GTTCCTGCGC TTGCTCAAGG (SEQ ID NO:51) |
| 35start.seq | GATCGACCAT GGCTCTGGAC CCGAACAACC TC (SEQ ID NO:52) |
| 34rev.seq | CTCGATTACG TACAAAGGTG CAGGTGGT (SEQ ID NO:53) |
| 70start.seq | GATCGACCAT GGCTAATGCA TCAGGTATTG AG (SEQ ID NO:54) |
| 69rev.seq | CTCGATTACG TATTCTAAGT TCTTGACA (SEQ ID NO:55) |
| 91start.seq | GATCGACCAT GGCTGCACCC TCTCGACATC CA (SEQ ID NO:56) |
| 90rev.seq | CTCGATTACG TAGGCCGTGG CAGAGGGC (SEQ ID NO:57) |
| 101start.seq | GATCGACCAT GGCTGCAGGT GACTGGCAAG AA (SEQ ID NO:58) |
| 100rev.seq | CTCGATTACG TACTTGATGA TGATTGGA (SEQ ID NO:59) |
| L-11start.seq | GCTCTGAGAG CCGCCAGAGC CGCCAGAGGG CTGCGCAAGG TGGCGTAGAA CGCG (SEQ ID NO:60) |
| L-11stop.seq | CAGCCCTCTG GCGGCTCTGG CGGCTCTCAG AGCTTCCTGC TCAAGTCTTT AGAG (SEQ ID NO:61) |

TABLE 1-continued

OLIGONUCLEOTIDES

| | |
|---|---|
| p-blstart.seq | GGGCTGCGCA AGGTGGCG (SEQ ID NO:62) |
| p-blstop.seq | ACACCATTGG GCCCTGCCAG C (SEQ ID NO:63) |
| 39start.seq | GATCGACCAT GGCTTACAAG CTGTGCCACC CC (SEQ ID NO:64) |
| 38stop.Seq | CGATCGAAGC TTATTAGGTG GCACACAGCT TCTCCT (SEQ ID NO:65) |
| 97start.seq | GATCGACCAT GGCTCCCGAG TTGGGTCCCA CC (SEQ ID NO:66) |
| 96stop.Seq | CGATCGAAGC TTATTAGGAT ATCCCTTCCA GGGCCT (SEQ ID NO:67) |
| 126start.seq | GATCGACCAT GGCTATGGCC CCTGCCCTGC AG (SEQ ID NO:68) |
| 125stop.Seq | CGATCGAAGC TTATTATCCC AGTTCTTCCA TCTGCT (SEQ ID NO:69) |
| 133start.seq | GATCGACCAT GGCTACCCAG GGTGCCATGC CG (SEQ ID NO:70) |
| 132stop.seq | CGATCGAAGC TTATTAGGGC TGCAGGGCAG GGGCCA (SEQ ID NO:71) |
| 142start.seq | GATCGACCAT GGCTTCTGCT TTCCAGCGCC GG (SEQ ID NO:72) |
| 141stop.Seq | CGATCGAAGC TTATTAGGCG AAGGCCGGCA TGGCAC (SEQ ID NO:73) |
| GLYXA1 | GTAGAGGGCG GTGGAGGCTC C (SEQ ID NO:74) |
| GLYXA2 | CCGGGGAGCC TCCACCGCCC TCTAC (SEQ ID NO:75) |
| 1GGGSfor | TTCTACGCCA CCTTGCGCAG CCCGGCGGCG GCTCTGACAT GTCTACACCA TTG (SEQ ID NO:76) |
| 1GGGSrev | CAATGGTGTA GACATGTCAG AGCCGCCGCC GGGCTGCGCA AGGTGGCGTA GAA (SEQ ID NO:77) |
| Synnoxa1.req | AATTCCGTCG TAAACTGACC TTCTATCTGA AAACCTTGGA GAACGCGCAG GCTCAACAGT ACGTAGAGGG CGGTGGAGGC TCC (SEQ ID NO:240) |
| Synnoxa2.req | CCGGGGAGCC TCCACCGCCC TCTACGTACT GTTGAGCCTG CGCGTTCTCC AAGGTTTTCA GATAGAAGGT CAGTTTACGA CGG (SEQ ID NO:241) |

TABLE 2

GENE SEQUENCES pMON30304
GCTAACTGCTCTATAATGATCGATGAAATTATACATCACTTAAAGAGACCACCTGCACCTTTGCTGG  (SEQ ID NO:78)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGT pMON26458
TCCCCAGCTCCACCTGCTTGTGACCTCCGAGTCCTCAGTAAACTGCTTCGTGACTCCCATGTCCTTC  (SEQ ID NO:79)

TABLE 2-continued

GENE SEQUENCES

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGCT

TCCTCCACAGGGCAGGACCACAGCTCACAAGGATCCCAATGCCATCTTCCTGAGCTTCCAACACCTG

CTCCGAGGAAAGGTGCGTTTCCTGATGCTTGTAGGAGGGTCCACCCTCTGCGTCAGGGAATTC pMON28548
TCCCCAGCTCCACCTGCTTGTGACCTCCGAGTCCTCAGTAAACTGCTTCGTGACTCCCATGTCCTTC (SEQ ID NO:80)

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGCT

TCCTCCACAGGGCAGGACCACAGCTCACAAGGATCCCAATGCCATCTTCCTGAGCTTCCAACACCTG

CTCCGAGGAAAGGTGCGTTTCCTGATGCTTGTAGGAGGGTCCACCCTCTGCGTCAGGGAATTCGGCG

GCAACATGGCGTCTCCCGCTCCGCCTGCTTGTGACCTCCGAGTCCTCAGTAAACTGCTTCGTGACTC

CCATGTCCTTCACAGCAGACTGAGCCAGTGCCCAGAGGTTCACCCTTTGCCTACACCTGTCCTGCTG

CCTGCTGTGGACTTTAGCTTGGGAGAATGGAAAACCCAGATGGAGGAGACCAAGGCACAGGACATTC

TGGGAGCAGTGACCCTTCTGCTGGAGGGAGTGATGGCAGCACGGGACAACTGGGACCCACTTGCCT

CTCATCCCTCCTGGGGCAGCTTTCTGGACAGGTCCGTCTCCTCCTTGGGGCCCTGCAGAGCCTCCTT

GGAACCCAGGGCAGGACCACAGCTCACAAGGATCCCAATGCCATCTTCCTGAGCTTCCAACACCTGC

TCCGAGGAAAGGTGCGTTTCCTGATGCTTGTAGGAGGGTCCACCCTCTGCGTCAGG pMON28500
TCCCCAGCTCCACCTGCTTGTGACCTCCGAGTCCTCAGTAAACTGCTTCGTGACTCCCATGTCCTTC (SEQ ID NO:81)

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGCT

TCCTCCACAGGGCAGGACCACAGCTCACAAGGATCCCAATGCCATCTTCCTGAGCTTCCAACACCTG

CTCCGAGGAAAGGTGCGTTTCCTGATGCTTGTAGGAGGGTCCACCCTCTGCGTCAGGGAATTCGGCA

ACATGGCGTCTCCCGCTCCGCCTGCTTGTGACCTCCGAGTCCTCAGTAAACTGCTTCGTGACTCCCA

TGTCCTTCACAGCAGACTGAGCCAGTGCCCAGAGGTTCACCCTTTGCCTACACCTGTCCTGCTGCCT

GCTGTGGACTTTAGCTTGGGAGAATGGAAAACCCAGATGGAGGAGACCAAGGCACAGGACATTCTGG

GAGCAGTGACCCTTCTGCTGGAGGGAGTGATGGCAGCACGGGACAACTGGGACCCACTTGCCTCTC

ATCCCTCCTGGGGCAGCTTTCTGGACAGGTCCGTCTCCTCCTTGGGGCCCTGCAGAGCCTCCTTGGA

ACCCAGCTTCCTCCACAGGGCAGGACCACAGCTCACAAGGATCCCAATGCCATCTTCCTGAGCTTCC

AACACCTGCTCCGAGGAAAGGTGCGTTTCCTGATGCTTGTAGGAGGGTCCACCCTCTGCGTCAGG pMON28501
TCCCCAGCTCCACCTGCTTGTGACCTCCGAGTCCTCAGTAAACTGCTTCGTGACTCCCATGTCCTTC (SEQ ID NO:82)

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

TABLE 2-continued

GENE SEQUENCES

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGCT

TCCTCCACAGGGCAGGACCACAGCTCACAAGGATCCCAATGCCATCTTCCTGAGCTTCCAACACCTG

CTCCGAGGAAAGGTGCGTTTCCTGATGCTTGTAGGAGGGTCCACCCTCTGCGTCAGGGAATTCGGCG

GCAACATGGCGTCTCCCGCTCCGCCTGCTTGTGACCTCCGAGTCCTCAGTAAACTGCTTCGTGACTC

CCATGTCCTTCACAGCAGACTGAGCCAGTGCCCAGAGGTTCACCCTTTGCCTACACCTGTCCTGCTG

CCTGCTGTGGACTTTAGCTTGGGAGAATGGAAAACCCAGATGGAGGAGACCAAGGCACAGGACATTC

TGGGAGCAGTGACCCTTCTGCTGGAGGGAGTGATGGCAGCACGGGACAACTGGGACCCACTTGCCT

CTCATCCCTCCTGGGGCAGCTTTCTGGACAGGTCCGTCTCCTCCTTGGGGCCCTGCAGAGCCTCCTT

GGAACCCAGCTTCCTCCACAGGGCAGGACCACAGCTCACAAGGATCCCAATGCCATCTTCCTGAGCT

TCCAACACCTGCTCCGAGGAAAGGTGCGTTTCCTGATGCTTGTAGGAGGGTCCACCCTCTGCGTCAG

G pMON28502
TCCCCAGCGCCGCCTGCTTGTGACCTCCGAGTCCTCAGTAAACTGCTTCGTGACTCCCATGTCCTTC    (SEQ ID NO:83)

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGCT

TCCTCCACAGGGCAGGACCACAGCTCACAAGGATCCCAATGCCATCTTCCTGAGCTTCCAACACCTG

CTCCGAGGAAAGGTGCGTTTCCTGATGCTTGTAGGAGGGTCCACCCTCTGCGTCAGGGAATTCGGCG

GCAACGGCGGCAACATGGCGTCCCCAGCGCCGCCTGCTTGTGACCTCCGAGTCCTCAGTAAACTGCT

TCGTGACTCCCATGTCCTTCACAGCAGACTGAGCCAGTGCCCAGAGGTTCACCCTTTGCCTACACCT

GTCCTGCTGCCTGCTGTGGACTTTAGCTTGGGAGAATGGAAAACCCAGATGGAGGAGACCAAGGCAC

AGGACATTCTGGGAGCAGTGACCCTTCTGCTGGAGGGAGTGATGGCAGCACGGGACAACTGGGACC

CACTTGCCTCTCATCCCTCCTGGGGCAGCTTTCTGGACAGGTCCGTCTCCTCCTTGGGGCCCTGCAG

AGCCTCCTTGGAACCCAGCTTCCTCCACAGGGCAGGACCACAGCTCACAAGGATCCCAATGCCATCT

TCCTGAGCTTCCAACACCTGCTCCGAGGAAAGGTGCGTTTCCTGATGCTTGTAGGAGGGTCCACCCT

CTGCGTCAGG

Syntan1
  1  CATGGCTAAC TGCTCTATAA TGATCGATGA AATTATACAT CACTTAAAGA              (SEQ ID NO:84)

51  GACCACCTGC ACCTTTGCTG ACCCGAACA  ACCTCAATGA CGAAGACGTC

101  TCTATCCTGA TGGACCGAAA CCTTCGACTT CCAAACCTGG AGAGCTTCGT

151  AAGGGCTGTC AAGAACTTAG AAAATGCATC AGGTATTGAG GCAATTCTTC

201  GTAATCTCCA ACCATGTCTG CCCTCTGCCA CGGCCGCACC CTCTCGACAT

251  CCAATCATCA TCAAGGCAGG TGACTGGCAA GAATTCCGGG AAAAACTGAC

301  GTTCTATCTG GTTACCCTTG AGCAAGCGCA GGAACAACAG GGTGGTGGCT

351  CTAACTGCTC TATAATGATC GATGAAATTA TACATCACTT AAAGAGACCA

401  CCTGCACCTT TGCTGGACCC GAACAACCTC AATGACGAAG ACGTCTCTAT

451  CCTGATGGAC CGAAACCTTC GACTTCCAAA CCTGGAGAGC TTCGTAAGGG

501  CTGTCAAGAA CTTAGAAAAT GCATCAGGTA TTGAGGCAAT TCTTCGTAAT

TABLE 2-continued

GENE SEQUENCES

```
551  CTCCAACCAT GTCTGCCCTC TGCCACGGCC GCACCCTCTC GACATCCAAT
601  CATCATCAAG GCAGGTGACT GGCAAGAATT CCGGGAAAAA CTGACGTTCT
651  ATCTGGTTAC CCTTGAGCAA GCGCAGGAAC AACAGTAC
```

Syntan3
```
  1  CATGGCTAAC TGCTCTATAA TGATCGATGA AATTATACAT CACTTAAAGA    (SEQ ID NO:85)
 51  GACCACCTGC ACCTTTGCTG ACCCGAACAA CCTCAATGA CGAAGACGTC
101  TCTATCCTGA TGGACCGAAA CCTTCGACTT CCAAACCTGG AGAGCTTCGT
151  AAGGGCTGTC AAGAACTTAG AAAATGCATC AGGTATTGAG GCAATTCTTC
201  GTAATCTCCA ACCATGTCTG CCCTCTGCCA CGGCCGCACC CTCTCGACAT
251  CCAATCATCA TCAAGGCAGG TGACTGGCAA GAATTCCGGG AAAAACTGAC
301  GTTCTATCTG GTTACCCTTG AGCAAGCGCA GGAACAACAG GGTGGTGGCT
351  CTGGCGGTGG CAGCGGCGGC GGTTCTAACT GCTCTATAAT GATCGATGAA
401  ATTATACATC ACTTAAAGAG ACCACCTGCA CCTTTGCTGG ACCCGAACAA
451  CCTCAATGAC GAAGACGTCT CTATCCTGAT GGACCGAAAC CTTCGACTTC
501  CAAACCTGGA GAGCTTCGTA AGGGCTGTCA AGAACTTAGA AAATGCATCA
551  GGTATTGAGG CAATTCTTCG TAATCTCCAA CCATGTCTGC CCTCTGCCAC
601  GGCCGCACCC TCTCGACATC CAATCATCAT CAAGGCAGGT GACTGGCAAG
651  AATTCCGGGA AAAACTGACG TTCTATCTGG TTACCCTTGA GCAAGCGCAG
701  GAACAACAGT AC
``` pMON31104
```
  1  ATGGCTCTGG ACCCGAACAA CCTCAATGAC GAAGACGTCT CTATCCTGAT    (SEQ ID NO:86)
 51  GGACCGAAAC CTTCGACTTC CAAACCTGGA GAGCTTCGTA AGGGCTGTCA
101  AGAACTTAGA AAATGCATCA GGTATTGAGG CAATTCTTCG TAATCTCCAA
151  CCATGTCTGC CCTCTGCCAC GGCCGCACCC TCTCGACATC CAATCATCAT
201  CAAGGCAGGT GACTGGCAAG AATTCCGGGA AAAACTGACG TTCTATCTGG
251  TTACCCTTGA GCAAGCGCAG GAACAACAGG GTGGTGGCTC TAACTGCTCT
301  ATAATGATCG ATGAAATTAT ACATCACTTA AAGAGACCAC CTGCACCTTT
351  GTACGTAGAG GGCGGTGGAG GCTCCCCGGG TGAACCGTCT GGTCCAATCT
401  CTACTATCAA CCCGTCTCCT CCGTCTAAAG AATCTCATAA ATCTCCAAAC
451  ATGGCTACCC AGGGTGCCAT GCCGGCCTTC GCCTCTGCTT CCAGCGCCG
501  GGCAGGAGGG GTCCTGGTTG CTAGCCATCT GCAGAGCTTC CTGGAGGTGT
551  CGTACCGCGT TCTACGCCAC CTTGCGCAGC CCTCTGGCGG CTCTGGCGGC
601  TCTCAGAGCT TCCTGCTCAA GTCTTTAGAG CAAGTGAGAA AGATCCAGGG
651  CGATGGCGCA GCGCTCCAGG AGAAGCTGTG TGCCACCTAC AAGCTGTGCC
701  ACCCCGAGGA GCTGGTGCTG CTCGGACACT CTCTGGGCAT CCCCTGGGCT
751  CCCCTGAGCT CCTGCCCCAG CCAGGCCCTG CAGCTGGCAG GCTGCTTGAG
801  CCAACTCCAT AGCGGCCTTT TCCTCTACCA GGGGCTCCTG CAGGCCCTGG
851  AAGGGATATC CCCCGAGTTG GGTCCCACCT TGGACACACT GCAGCTGGAC
901  GTCGCCGACT TTGCCACCAC CATCTGGCAG CAGATGGAAG AACTGGGAAT
```

TABLE 2-continued

GENE SEQUENCES

951 GGCCCCTGCC CTGCAGCCCT AATAA pMON31105
```
  1 ATGGCTAATG CATCAGGTAT TGAGGCAATT CTTCGTAATC TCCAACCATG         (SEQ ID NO:87)
 51 TCTGCCCTCT GCCACGGCCG CACCCTCTCG ACATCCAATC ATCATCAAGG
101 CAGGTGACTG GCAAGAATTC CGGGAAAAAC TGACGTTCTA TCTGGTTACC
151 CTTGAGCAAG CGCAGGAACA ACAGGGTGGT GGCTCTAACT GCTCTATAAT
201 GATCGATGAA ATTATACATC ACTTAAAGAG ACCACCTGCA CCTTTGCTGG
251 ACCCGAACAA CCTCAATGAC GAAGACGTCT CTATCCTGAT GGACCGAAAC
301 CTTCGACTTC CAAACCTGGA GAGCTTCGTA AGGGCTGTCA AGAACTTAGA
351 ATACGTAGAG GGCGGTGGAG GCTCCCCGGG TGAACCGTCT GGTCCAATCT
401 CTACTATCAA CCCGTCTCCT CCGTCTAAAG AATCTCATAA ATCTCCAAAC
451 ATGGCTACCC AGGGTGCCAT GCCGGCCTTC GCCTCTGCTT TCCAGCGCCG
501 GGCAGGAGGG GTCCTGGTTG CTAGCCATCT GCAGAGCTTC CTGGAGGTGT
551 CGTACCGCGT TCTACGCCAC CTTGCGCAGC CCTCTGGCGG CTCTGGCGGC
601 TCTCAGAGCT TCCTGCTCAA GTCTTTAGAG CAAGTGAGAA AGATCCAGGG
651 CGATGGCGCA GCGCTCCAGG AGAAGCTGTG TGCCACCTAC AAGCTGTGCC
701 ACCCCGAGGA GCTGGTGCTG CTCGGACACT CTCTGGGCAT CCCCTGGGCT
751 CCCCTGAGCT CCTGCCCCAG CCAGGCCCTG CAGCTGGCAG GCTGCTTGAG
801 CCAACTCCAT AGCGGCCTTT TCCTCTACCA GGGGCTCCTG CAGGCCCTGG
851 AAGGGATATC CCCCGAGTTG GGTCCCACCT TGGACACACT GCAGCTGGAC
901 GTCGCCGACT TTGCCACCAC CATCTGGCAG CAGATGGAAG AACTGGGAAT
951 GGCCCCTGCC CTGCAGCCCT AATAA
``` pMON31106
```
  1 ATGGCTGCAC CCTCTCGACA TCCAATCATC ATCAAGGCAG GTGACTGGCA         (SEQ ID NO:88)
 51 AGAATTCCGG GAAAAACTGA CGTTCTATCT GGTTACCCTT GAGCAAGCGC
101 AGGAACAACA GGGTGGTGGC TCTAACTGCT CTATAATGAT CGATGAAATT
151 ATACATCACT TAAAGAGACC ACCTGCACCT TTGCTGGACC CGAACAACCT
201 CAATGACGAA GACGTCTCTA TCCTGATGGA CCGAAACCTT CGACTTCCAA
251 ACCTGGAGAG CTTCGTAAGG GCTGTCAAGA ACTTAGAAAA TGCATCAGGT
301 ATTGAGGCAA TTCTTCGTAA TCTCCAACCA TGTCTGCCCT CTGCCACGGC
351 CTACGTAGAG GGCGGTGGAG GCTCCCCGGG TGAACCGTCT GGTCCAATCT
401 CTACTATCAA CCCGTCTCCT CCGTCTAAAG AATCTCATAA ATCTCCAAAC
451 ATGGCTACCC AGGGTGCCAT GCCGGCCTTC GCCTCTGCTT TCCAGCGCCG
501 GGCAGGAGGG GTCCTGGTTG CTAGCCATCT GCAGAGCTTC CTGGAGGTGT
551 CGTACCGCGT TCTACGCCAC CTTGCGCAGC CCTCTGGCGG CTCTGGCGGC
601 TCTCAGAGCT TCCTGCTCAA GTCTTTAGAG CAAGTGAGAA AGATCCAGGG
651 CGATGGCGCA GCGCTCCAGG AGAAGCTGTG TGCCACCTAC AAGCTGTGCC
701 ACCCCGAGGA GCTGGTGCTG CTCGGACACT CTCTGGGCAT CCCCTGGGCT
751 CCCCTGAGCT CCTGCCCCAG CCAGGCCCTG CAGCTGGCAG GCTGCTTGAG
801 CCAACTCCAT AGCGGCCTTT TCCTCTACCA GGGGCTCCTG CAGGCCCTGG
```

TABLE 2-continued

GENE SEQUENCES

851 AAGGGATATC CCCCGAGTTG GGTCCCACCT TGGACACACT GCAGCTGGAC

901 GTCGCCGACT TGCCACCAC CATCTGGCAG CAGATGGAAG AACTGGGAAT

951 GGCCCCTGCC CTGCAGCCCT AATAA pMON31107
  1 ATGGCTGCAG GTGACTGGCA AGAATTCCGG GAAAAACTGA CGTTCTATCT    (SEQ ID NO:89)

51 GGTTACCCTT GAGCAAGCGC AGGAACAACA GGGTGGTGGC TCTAACTGCT

101 CTATAATGAT CGATGAAATT ATACATCACT TAAAGAGACC ACCTGCACCT

151 TTGCTGGACC CGAACAACCT CAATGACGAA GACGTCTCTA TCCTGATGGA

201 CCGAAACCTT CGACTTCCAA ACCTGGAGAG CTTCGTAAGG GCTGTCAAGA

251 ACTTAGAAAA TGCATCAGGT ATTGAGGCAA TTCTTCGTAA TCTCCAACCA

301 TGTCTGCCCT CTGCCACGGC CGCACCCTCT CGACATCCAA TCATCATCAA

351 GTACGTAGAG GCGGTGGAG GCTCCCCGGG TGAACCGTCT GGTCCAATCT

401 CTACTATCAA CCCGTCTCCT CCGTCTAAAG AATCTCATAA ATCTCCAAAC

451 ATGGCTACCC AGGGTGCCAT GCCGGCCTTC GCCTCTGCTT TCCAGCGCCG

501 GGCAGGAGGG GTCCTGGTTG CTAGCCATCT GCAGAGCTTC CTGGAGGTGT

551 CGTACCGCGT TCTACGCCAC CTTGCGCAGC CCTCTGGCGG CTCTGGCGGC

601 TCTCAGAGCT TCCTGCTCAA GTCTTTAGAG CAAGTGAGAA AGATCCAGGG

651 CGATGGCGCA GCGCTCCAGG AGAAGCTGTG TGCCACCTAC AAGCTGTGCC

701 ACCCCGAGGA GCTGGTGCTG CTCGGACACT CTCTGGGCAT CCCCTGGGCT

751 CCCCTGAGCT CCTGCCCCAG CCAGGCCCTG CAGCTGGCAG GCTGCTTGAG

801 CCAACTCCAT AGCGGCCTTT TCCTCTACCA GGGGCTCCTG CAGGCCCTGG

851 AAGGGATATC CCCCGAGTTG GGTCCCACCT TGGACACACT GCAGCTGGAC

901 GTCGCCGACT TGCCACCAC CATCTGGCAG CAGATGGAAG AACTGGGAAT

951 GGCCCCTGCC CTGCAGCCCT AATAA pMON31108
  1 ATGGCTCTGG ACCCGAACAA CCTCAATGAC GAAGACGTCT CTATCCTGAT    (SEQ ID NO:90)

51 GGACCGAAAC CTTCGACTTC CAAACCTGGA GAGCTTCGTA AGGGCTGTCA

101 AGAACTTAGA AAATGCATCA GGTATTGAGG CAATTCTTCG TAATCTCCAA

151 CCATGTCTGC CCTCTGCCAC GGCCGCACCC TCTCGACATC CAATCATCAT

201 CAAGGCAGGT GACTGGCAAG AATTCCGGGA AAAACTGACG TTCTATCTGG

251 TTACCCTTGA GCAAGCGCAG GAACAACAGG GTGGTGGCTC TGGCGGTGGC

301 AGCGGCGGCG GTTCTAACTG CTCTATAATG ATCGATGAAA TTATACATCA

351 CTTAAAGAGA CCACCTGCAC CTTTGTACGT AGAGGGCGGT GGAGGCTCCC

401 CGGGTGAACC GTCTGGTCCA ATCTCTACTA TCAACCCGTC TCCTCCGTCT

451 AAAGAATCTC ATAAATCTCC AAACATGGCT ACCCAGGGTG CCATGCCGGC

501 CTTCGCCTCT GCTTTCCAGC GCCGGGCAGG AGGGGTCCTG GTTGCTAGCC

551 ATCTGCAGAG CTTCCTGGAG GTGTCGTACC GCGTTCTACG CCACCTTGCG

601 CAGCCCTCTG GCGGCTCTGG CGGCTCTCAG AGCTTCCTGC TCAAGTCTTT

651 AGAGCAAGTG AGAAAGATCC AGGGCGATGG CGCAGCGCTC CAGGAGAAGC

TABLE 2-continued

GENE SEQUENCES

```
701  TGTGTGCCAC CTACAAGCTG TGCCACCCCG AGGAGCTGGT GCTGCTCGGA
751  CACTCTCTGG GCATCCCCTG GCTCCCCTG  AGCTCCTGCCC CAGCCAGGC
801  CCTGCAGCTG GCAGGCTGCT TGAGCCAACT CCATAGCGGC CTTTTCCTCT
851  ACCAGGGGCT CCTGCAGGCC CTGGAAGGGA TATCCCCCGA GTTGGGTCCC
901  ACCTTGGACA CACTGCAGCT GGACGTCGCC GACTTTGCCA CCACCATCTG
951  GCAGCAGATG GAAGAACTGG GAATGGCCCC TGCCCTGCAG CCCTAATAA
```

PMON31109
```
  1  ATGGCTAATG CATCAGGTAT TGAGGCAATT CTTCGTAATC TCCAACCATG         (SEQ ID NO:91)
 51  TCTGCCCTCT GCCACGGCCG CACCCTCTCG ACATCCAATC ATCATCAAGG
101  CAGGTGACTG GCAAGAATTC CGGGAAAAAC TGACGTTCTA TCTGGTTACC
151  CTTGAGCAAG CGCAGGAACA ACAGGGTGGT GGCTCTGGCG GTGGCAGCGG
201  CGGCGGTTCT AACTGCTCTA TAATGATCGA TGAAATTATA CATCACTTAA
251  AGAGACCACC TGCACCTTTG CTGGACCCGA ACAACCTCAA TGACGAAGAC
301  GTCTCTATCC TGATGGACCG AAACCTTCGA CTTCCAAACC TGGAGAGCTT
351  CGTAAGGGCT GTCAAGAACT TAGAATACGT AGAGGGCGGT GGAGGCTCCC
401  CGGGTGAACC GTCTGGTCCA ATCTCTACTA TCAACCCGTC TCCTCCGTCT
451  AAAGAATCTC ATAAATCTCC AAACATGGCT ACCCAGGGTG CCATGCCGGC
501  CTTCGCCTCT GCTTTCCAGC GCCGGGCAGG AGGGGTCCTG GTTGCTAGCC
551  ATCTGCAGAG CTTCCTGGAG GTGTCGTACC GCGTTCTACG CCACCTTGCG
601  CAGCCCTCTG GCGGCTCTGG CGGCTCTCAG AGCTTCCTGC TCAAGTCTTT
651  AGAGCAAGTG AGAAAGATCC AGGGCGATGG CGCAGCGCTC CAGGAGAAGC
701  TGTGTGCCAC CTACAAGCTG TGCCACCCCG AGGAGCTGGT GCTGCTCGGA
751  CACTCTCTGG GCATCCCCTG GCTCCCCTG  AGCTCCTGCC CCAGCCAGGC
801  CCTGCAGCTG GCAGGCTGCT TGAGCCAACT CCATAGCGGC CTTTTCCTCT
851  ACCAGGGGCT CCTGCAGGCC CTGGAAGGGA TATCCCCCGA GTTGGGTCCC
901  ACCTTGGACA CACTGCAGCT GGACGTCGCC GACTTTGCCA CCACCATCTG
951  GCAGCAGATG GAAGAACTGG GAATGGCCCC TGCCCTGCAG CCCTAATAA
``` pMON31110
```
  1  ATGGCTGCAC CCTCTCGACA TCCAATCATC ATCAAGGCAG GTGACTGGCA         (SEQ ID NO:92)
 51  AGAATTCCGG GAAAAACTGA CGTTCTATCT GGTTACCCTT GAGCAAGCGC
101  AGGAACAACA GGGTGGTGGC TCTGGCGGTG GCAGCGGCGG CGGTTCTAAC
151  TGCTCTATAA TGATCGATGA AATTATACAT CACTTAAAGA GACCACCTGC
201  ACCTTTGCTG GACCCGAACA ACCTCAATGA CGAAGACGTC TCTATCCTGA
251  TGGACCGAAA CCTTCGACTT CCAAACCTGG AGAGCTTCGT AAGGGCTGTC
301  AAGAACTTAG AAAATGCATC AGGTATTGAG GCAATTCTTC GTAATCTCCA
351  ACCATGTCTG CCCTCTGCCA CGGCCTACGT AGAGGGCGGT GGAGGCTCCC
401  CGGGTGAACC GTCTGGTCCA ATCTCTACTA TCAACCCGTC TCCTCCGTCT
451  AAAGAATCTC ATAAATCTCC AAACATGGCT ACCCAGGGTG CCATGCCGGC
501  CTTCGCCTCT GCTTTCCAGC GCCGGGCAGG AGGGGTCCTG GTTGCTAGCC
551  ATCTGCAGAG CTTCCTGGAG GTGTCGTACC GCGTTCTACG CCACCTTGCG
```

TABLE 2-continued

GENE SEQUENCES

```
601  CAGCCCTCTG GCGGCTCTGG CGGCTCTCAG AGCTTCCTGC TCAAGTCTTT
651  AGAGCAAGTG AGAAAGATCC AGGGCGATGG CGCAGCGCTC CAGGAGAAGC
701  TGTGTGCCAC CTACAAGCTG TGCCACCCCG AGGAGCTGGT GCTGCTCGGA
751  CACTCTCTGG GCATCCCCTG GCTCCCCTG AGCTCCTGCC CCAGCCAGGC
801  CCTGCAGCTG GCAGGCTGCT TGAGCCAACT CCATAGCGGC CTTTTCCTCT
851  ACCAGGGGCT CCTGCAGGCC CTGGAAGGGA TATCCCCCGA GTTGGGTCCC
901  ACCTTGGACA CACTGCAGCT GGACGTCGCC GACTTTGCCA CCACCATCTG
951  GCAGCAGATG GAAGAACTGG GAATGGCCCC TGCCCTGCAG CCCTAATAA
``` pMON31111
```
  1  ATGGCTGCAG GTGACTGGCA AGAATTCCGG GAAAAACTGA CGTTCTATCT          (SEQ ID NO:93)
 51  GGTTACCCTT GAGCAAGCGC AGGAACAACA GGGTGGTGGC TCTGGCGGTG
101  GCAGCGGCGG CGGTTCTAAC TGCTCTATAA TGATCGATGA AATTATACAT
151  CACTTAAAGA GACCACCTGC ACCTTTGCTG ACCCGAACA ACCTCAATGA
201  CGAAGACGTC TCTATCCTGA TGGACCGAAA CCTTCGACTT CCAAACCTGG
251  AGAGCTTCGT AAGGGCTGTC AAGAACTTAG AAAATGCATC AGGTATTGAG
301  GCAATTCTTC GTAATCTCCA ACCATGTCTG CCCTCTGCCA CGGCCGCACC
351  CTCTCGACAT CCAATCATCA TCAAGTACGT AGAGGGCGGT GGAGGCTCCC
401  CGGGTGAACC GTCTGGTCCA ATCTCTACTA TCAACCCGTC TCCTCCGTCT
451  AAAGAATCTC ATAAATCTCC AAACATGGCT ACCCAGGGTG CCATGCCGGC
501  CTTCGCCTCT GCTTTCCAGC GCCGGGCAGG AGGGGTCCTG GTTGCTAGCC
551  ATCTGCAGAG CTTCCTGGAG GTGTCGTACC GCGTTCTACG CCACCTTGCG
601  CAGCCCTCTG GCGGCTCTGG CGGCTCTCAG AGCTTCCTGC TCAAGTCTTT
651  AGAGCAAGTG AGAAAGATCC AGGGCGATGG CGCAGCGCTC CAGGAGAAGC
701  TGTGTGCCAC CTACAAGCTG TGCCACCCCG AGGAGCTGGT GCTGCTCGGA
751  CACTCTCTGC GCATCCCCTG GCTCCCCTG AGCTCCTGCC CCAGCCAGGC
801  CCTGCAGCTG GCAGGCTGCT TGAGCCAACT CCATAGCGGC CTTTTCCTCT
851  ACCAGGGGCT CCTGCAGGCC CTGGAAGGGA TATCCCCCGA GTTGGGTCCC
901  ACCTTGGACA CACTGCAGCT GGACGTCGCC GACTTTGCCA CCACCATCTG
951  GCAGCAGATG GAAGAACTGG GAATGGCCCC TGCCCTGCAG CCCTAATAA
``` pMON13182
```
  1  ATGGCTAACT GCTCTATAAT GATCGATGAA ATTATACATC ACTTAAAGAG          (SEQ ID NO:94)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG TGGTTCTGG CGGCGGCTCC AACATGGCTT
401  ACAAGCTGTG CCACCCCGAG GAGCTGGTGC TGCTCGGACA CTCTCTGGGC
```

TABLE 2-continued

GENE SEQUENCES

```
451  ATCCCCTGGG CTCCCCTGAG CTCCTGCCCC AGCCAGGCCC TGCAGCTGGC

501  AGGCTGCTTG AGCCAACTCC ATAGCGGCCT TTTCCTCTAC CAGGGGCTCC

551  TGCAGGCCCT GGAAGGGATA TCCCCCGAGT TGGGTCCCAC CTTGGACACA

601  CTGCAGCTGG ACGTCGCCGA CTTTGCCACC ACCATCTGGC AGCAGATGGA

651  AGAACTGGGA ATGGCCCCTG CCCTGCAGCC CACCCAGGGT GCCATGCCGG

701  CCTTCGCCTC TGCTTTCCAG CGCCGGGCAG GAGGGTCCT GGTTGCTAGC

751  CATCTGCAGA GCTTCCTGGA GGTGTCGTAC CGCGTTCTAC GCCACCTTGC

801  GCAGCCCTCT GGCGGCTCTG GCGGCTCTCA GAGCTTCCTG CTCAAGTCTT

851  TAGAGCAAGT GAGAAAGATC CAGGGCGATG GCGCAGCGCT CCAGGAGAAG

901  CTGTGTGCCA CCTAATAA
``` pMON13183

```
  1  ATGGCTAACT GCTCTATAAT GATCGATGAA ATTATACATC ACTTAAAGAG     (SEQ ID NO:95)

51  ACCACCTGCA CCTTTGCTGG ACCCGAACAA CCTCAATGAC GAAGACGTCT

101  CTATCCTGAT GGACCGAAAC CTTCGACTTC CAAACCTGGA GAGCTTCGTA

151  AGGGCTGTCA AGAACTTAGA AAATGCATCA GGTATTGAGG CAATTCTTCG

201  TAATCTCCAA CCATGTCTGC CCTCTGCCAC GGCCGCACCC TCTCGACATC

251  CAATCATCAT CAAGGCAGGT GACTGGCAAG AATTCCGGGA AAAACTGACG

301  TTCTATCTGG TTACCCTTGA GCAAGCGCAG GAACAACAGT ACGTAGAGGG

351  CGGTGGAGGC TCCCCGGGTG AACCGTCTGG TCCAATCTCT ACTATCAACC

401  CGTCTCCTCC GTCTAAAGAA TCTCATAAAT CTCCAAACAT GGCTTACAAG

451  CTGTGCCACC CGAGGAGCT GGTGCTGCTC GGACACTCTC TGGGCATCCC

501  CTGGGCTCCC CTGAGCTCCT GCCCCAGCCA GGCCCTGCAG CTGGCAGGCT

551  GCTTGAGCCA ACTCCATAGC GGCCTTTTCC TCTACCAGGG GCTCCTGCAG

601  GCCCTGGAAG GGATATCCCC CGAGTTGGGT CCCACCTTGG ACACACTGCA

651  GCTGGACGTC GCCGACTTTG CCACCACCAT CTGGCAGCAG ATGGAAGAAC

701  TGGGAATGGC CCCTGCCCTG CAGCCCACCC AGGGTGCCAT GCCGGCCTTC

751  GCCTCTGCTT TCCAGCGCCG GGCAGGAGGG GTCCTGGTTG CTAGCCATCT

801  GCAGAGCTTC CTGGAGGTGT CGTACCGCGT TCTACGCCAC CTTGCGCAGC

851  CCTCTGGCGG CTCTGGCGGC TCTCAGAGCT TCCTGCTCAA GTCTTTAGAG

901  CAAGTGAGAA AGATCCAGGG CGATGGCGCA GCGCTCCAGG AGAAGCTGTG

951  TGCCACCTAA TAA
``` pMON13184

```
  1  ATGGCTAACT GCTCTATAAT GATCGATGAA ATTATACATC ACTTAAAGAG     (SEQ ID NO:96)

51  ACCACCTGCA CCTTTGCTGG ACCCGAACAA CCTCAATGAC GAAGACGTCT

101  CTATCCTGAT GGACCGAAAC CTTCGACTTC CAAACCTGGA GAGCTTCGTA

151  AGGGCTGTCA AGAACTTAGA AAATGCATCA GGTATTGAGG CAATTCTTCG

201  TAATCTCCAA CCATGTCTGC CCTCTGCCAC GGCCGCACCC TCTCGACATC

251  CAATCATCAT CAAGGCAGGT GACTGGCAAG AATTCCGGGA AAAACTGACG

301  TTCTATCTGG TTACCCTTGA GCAAGCGCAG GAACAACAGT ACGTAGAGGG

351  CGGTGGAGGC TCCCCGGGTG GTGGTTCTGG CGGCGGCTCC AACATGGCTC
```

TABLE 2-continued

GENE SEQUENCES

```
401  CCGAGTTGGG TCCCACCTTG GACACACTGC AGCTGGACGT CGCCGACTTT
451  GCCACCACCA TCTGGCAGCA GATGGAAGAA CTGGGAATGG CCCCTGCCCT
501  GCAGCCCACC CAGGGTGCCA TGCCGGCCTT CGCCTCTGCT TTCCAGCGCC
551  GGGCAGGAGG GGTCCTGGTT GCTAGCCATC TGCAGAGCTT CCTGGAGGTG
601  TCGTACCGCG TTCTACGCCA CCTTGCGCAG CCCTCTGGCG GCTCTGGCGG
651  CTCTCAGAGC TTCCTGCTCA AGTCTTTAGA GCAAGTGAGA AGATCCAGG
701  GCGATGGCGC AGCGCTCCAG GAGAAGCTGT GTGCCACCTA CAAGCTGTGC
751  CACCCCGAGG AGCTGGTGCT GCTCGGACAC TCTCTGGGCA TCCCCTGGGC
801  TCCCCTGAGC TCCTGCCCCA GCCAGGCCCT GCAGCTGGCA GGCTGCTTGA
851  GCCAACTCCA TAGCGGCCTT TTCCTCTACC AGGGGCTCCT GCAGGCCCTG
901  GAAGGGATAT CCTAATAA
``` pMON13185
```
  1  ATGGCTAACT GCTCTATAAT GATCGATGAA ATTATACATC ACTTAAAGAG   (SEQ ID NO:97)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTCCCGAG
451  TTGGGTCCCA CCTTGGACAC ACTGCAGCTG GACGTCGCCG ACTTTGCCAC
501  CACCATCTGG CAGCAGATGG AAGAACTGGG AATGGCCCCT GCCCTGCAGC
551  CCACCCAGGG TGCCATGCCG GCCTTCGCCT CTGCTTTCCA GCGCCGGGCA
601  GGAGGGGTCC TGGTTGCTAG CCATCTGCAG AGCTTCCTGG AGGTGTCGTA
651  CCGCGTTCTA CGCCACCTTG CGCAGCCCTC TGGCGGCTCT GGCGGCTCTC
701  AGAGCTTCCT GCTCAAGTCT TTAGAGCAAG TGAGAAAGAT CCAGGGCGAT
751  GGCGCAGCGC TCCAGGAGAA GCTGTGTGCC ACCTACAAGC TGTGCCACCC
801  CGAGGAGCTG GTGCTGCTCG GACACTCTCT GGGCATCCCC TGGGCTCCCC
851  TGAGCTCCTG CCCCAGCCAG GCCCTGCAGC TGGCAGGCTG CTTGAGCCAA
901  CTCCATAGCG GCCTTTTCCT CTACCAGGGG CTCCTGCAGG CCCTGGAAGG
951  GATATCCTAA TAA
``` pMON13186
```
  1  ATGGCTAACT GCTCTATAAT GATCGATGAA ATTATACATC ACTTAAAGAG   (SEQ ID NO:98)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
```

TABLE 2-continued

GENE SEQUENCES

```
301  TTCTATCTGG TTACCCTTGA GCAAGCGCAG GAACAACAGT ACGTAGAGGG
351  CGGTGGAGGC TCCCCGGGTG GTGGTTCTGG CGGCGGCTCC AACATGGCTA
401  TGGCCCCTGC CCTGCAGCCC ACCCAGGGTG CCATGCCGGC CTTCGCCTCT
451  GCTTTCCAGC GCCGGGCAGG AGGGGTCCTG GTTGCTAGCC ATCTGCAGAG
501  CTTCCTGGAG GTGTCGTACC GCGTTCTACG CCACCTTGCG CAGCCCTCTG
551  GCGGCTCTGG CGGCTCTCAG AGCTTCCTGC TCAAGTCTTT AGAGCAAGTG
601  AGAAAGATCC AGGGCGATGG CGCAGCGCTC CAGGAGAAGC TGTGTGCCAC
651  CTACAAGCTG TGCCACCCCG AGGAGCTGGT GCTGCTCGGA CACTCTCTGG
701  GCATCCCCTG GCTCCCCTG AGCTCCTGCC CCAGCCAGGC CCTGCAGCTG
751  GCAGGCTGCT TGAGCCAACT CCATAGCGGC CTTTTCCTCT ACCAGGGGCT
801  CCTGCAGGCC CTGGAAGGGA TATCCCCCGA GTTGGGTCCC ACCTTGGACA
851  CACTGCAGCT GGACGTCGCC GACTTTGCCA CCACCATCTG GCAGCAGATG
901  GAAGAACTGG GATAATAA
``` pMON13187
```
  1  ATGGCTAACT GCTCTATAAT GATCGATGAA ATTATACATC ACTTAAAGAG        (SEQ ID NO:99)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTATGGCC
451  CCTGCCCTGC AGCCCACCCA GGGTGCCATG CCGGCCTTCG CCTCTGCTTT
501  CCAGCGCCGG GCAGGAGGGG TCCTGGTTGC TAGCCATCTG CAGAGCTTCC
551  TGGAGGTGTC GTACCGCGTT CTACGCCACC TTGCGCAGCC CTCTGGCGGC
601  TCTGGCGGCT CTCAGAGCTT CCTGCTCAAG TCTTTAGAGC AAGTGAGAAA
651  GATCCAGGGC GATGGCGCAG CGCTCCAGGA GAAGCTGTGT GCCACCTACA
701  AGCTGTGCCA CCCCGAGGAG CTGGTGCTGC TCGGACACTC TCTGGGCATC
751  CCCTGGGCTC CCCTGAGCTC CTGCCCCAGC CAGGCCCTGC AGCTGGCAGG
801  CTGCTTGAGC CAACTCCATA GCGGCCTTTT CCTCTACCAG GGCTCCTGC
851  AGGCCCTGGA AGGGATATCC CCCGAGTTGG GTCCCACCTT GGACACACTG
901  CAGCTGGACG TCGCCGACTT TGCCACCACC ATCTGGCAGC AGATGGAAGA
951  ACTGGGATAA TAA
``` pMON13188
```
  1  ATGGCTAACT GCTCTATAAT GATCGATGAA ATTATACATC ACTTAAAGAG        (SEQ ID NO:100)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
```

TABLE 2-continued

GENE SEQUENCES

```
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG GTGGTTCTGG CGGCGGCTCC AACATGGCTA
401  CCCAGGGTGC CATGCCGGCC TTCGCCTCTG CTTTCCAGCG CCGGGCAGGA
451  GGGGTCCTGG TTGCTAGCCA TCTGCAGAGC TTCCTGGAGG TGTCGTACCG
501  CGTTCTACGC CACCTTGCGC AGCCCTCTGG CGGCTCTGGG GGCTCTCAGA
551  GCTTCCTGCT CAAGTCTTTA GAGCAAGTGA GAAAGATCCA GGGCGATGGC
601  GCAGCGCTCC AGGAGAAGCT GTGTGCCACC TACAAGCTGT GCCACCCCGA
651  GGAGCTGGTG CTGCTCGGAC ACTCTCTGGG CATCCCCTGG GCTCCCCTGA
701  GCTCCTGCCC CAGCCAGGCC CTGCAGCTGG CAGGCTGCTT GAGCCAACTC
751  CATAGCGGCC TTTTCCTCTA CCAGGGGCTC CTGCAGGCCC TGGAAGGGAT
801  ATCCCCCGAG TTGGGTCCCA CCTTGGACAC ACTGCAGCTG GACGTCGCCG
851  ACTTTGCCAC CACCATCTGG CAGCAGATGG AAGAACTGGG AATGGCCCCT
901  GCCCTGCAGC CCTAATAA
``` pMON13189

```
  1  ATGGCTAACT GCTCTATAAT GATCGATGAA ATTATACATC ACTTAAAGAG     (SEQ ID NO:101)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTACCCAG
451  GGTGCCATGC CGGCCTTCGC CTCTGCTTTC AGCGCCGGG CAGGAGGGGT
501  CCTGGTTGCT AGCCATCTGC AGAGCTTCCT GGAGGTGTCG TACCGCGTTC
551  TACGCCACCT TGCGCAGCCC TCTGGCGGCT CTGGCGGCTC TCAGAGCTTC
601  CTGCTCAAGT CTTTAGAGCA AGTGAGAAAG ATCCAGGGCG ATGGCGCAGC
651  GCTCCAGGAG AAGCTGTGTG CCACCTACAA GCTGTGCCAC CCCGAGGAGC
701  TGGTGCTGCT CGGACACTCT CTGGGCATCC CCTGGGCTCC CCTGAGCTCC
751  TGCCCCAGCC AGGCCCTGCA GCTGGCAGGC TGCTTGAGCC AACTCCATAG
801  CGGCCTTTTC CTCTACCAGG GGCTCCTGCA GGCCCTGGAA GGGATATCCC
851  CCGAGTTGGG TCCCACCTTG GACACACTGC AGCTGGACGT CGCCGACTTT
901  GCCACCACCA TCTGGCAGCA GATGGAAGAA CTGGGAATGG CCCCTGCCCT
951  GCAGCCCTAA TAA
``` pMON13190

```
  1  ATGGCTAACT GCTCTATAAT GATCGATGAA ATTATACATC ACTTAAAGAG     (SEQ ID NO:102)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
```

TABLE 2-continued

GENE SEQUENCES

```
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTT
401 CTGCTTTCCA GCGCCGGGCA GGAGGGGTCC TGGTTGCTAG CCATCTGCAG
451 AGCTTCCTGG AGGTGTCGTA CCGCGTTCTA CGCCACCTTG CGCAGCCCTC
501 TGGCGGCTCT GGCGGCTCTC AGAGCTTCCT GCTCAAGTCT TTAGAGCAAG
551 TGAGAAAGAT CCAGGGCGAT GGCGCAGCGC TCCAGGAGAA GCTGTGTGCC
601 ACCTACAAGC TGTGCCACCC CGAGGAGCTG GTGCTGCTCG ACACTCTCT
651 GGGCATCCCC TGGGCTCCCC TGAGCTCCTG CCCCAGCCAG GCCCTGCAGC
701 TGGCAGGCTG CTTGAGCCAA CTCCATAGCG GCCTTTTCCT CTACCAGGGG
751 CTCCTGCAGG CCCTGGAAGG GATATCCCCC GAGTTGGGTC CCACCTTGGA
801 CACACTGCAG CTGGACGTCG CCGACTTTGC CACCACCATC TGGCAGCAGA
851 TGGAAGAACT GGGAATGGCC CCTGCCCTGC AGCCCACCCA GGGTGCCATG
901 CCGGCCTTCG CCTAATAA
``` pMON13191

```
  1 ATGGCTAACT GCTCTATAAT GATCGATGAA ATTATACATC ACTTAAAGAG    (SEQ ID NO:103)
 51 ACCACCTGCA CCTTTGCTGG ACCCGAACAA CCTCAATGAC GAAGACGTCT
101 CTATCCTGAT GGACCGAAAC CTTCGACTTC AAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTTCTGCT
451 TTCCAGCGCC GGGCAGGAGG GGTCCTGGTT GCTAGCCATC TGCAGAGCTT
501 CCTGGAGGTG TCGTACCGCG TTCTACGCCA CCTTGCGCAG CCCTCTGGCG
551 GCTCTGGCGG CTCTCAGAGC TTCCTGCTCA AGTCTTTAGA GCAAGTGAGA
601 AAGATCCAGG GCGATGGCGC AGCGCTCCAG GAGAAGCTGT GTGCCACCTA
651 CAAGCTGTGC ACCCCGAGG AGCTGGTGCT GCTCGGACAC TCTCTGGGCA
701 TCCCCTGGGC TCCCCTGAGC TCCTGCCCCA GCCAGGCCCT GCAGCTGGCA
751 GGCTGCTTGA GCCAACTCCA TAGCGGCCTT TTCCTCTACC AGGGGCTCCT
801 GCAGGCCCTG GAAGGGATAT CCCCGAGTT GGGTCCCACC TTGGACACAC
851 TGCAGCTGGA CGTCGCCGAC TTTGCCACCA CCATCTGGCA GCAGATGGAA
901 GAACTGGGAA TGGCCCCTGC CCTGCAGCCC ACCCAGGGTG CCATGCCGGC
951 CTTCGCCTAA TAA
``` pMON13192

```
  1 ATGGCTAACT GCTCTATAAT GATCGATGAA ATTATACATC ACTTAAAGAG    (SEQ ID NO:104)
 51 ACCACCTGCA CCTTTGCTGG ACCCGAACAA CCTCAATGAC GAAGACGTCT
```

TABLE 2-continued

GENE SEQUENCES

```
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG GTGGTTCTGG CGGCGGCTCC AACATGGCTT
401  ACAAGCTGTG CCACCCCGAG GAGCTGGTGC TGCTCGGACA CTCTCTGGGC
451  ATCCCCTGGG CTCCCCTGAG CTCCTGCCCC AGCCAGGCCC TGCAGCTGGC
501  AGGCTGCTTG AGCCAACTCC ATAGCGGCCT TTTCCTCTAC CAGGGGCTCC
551  TGCAGGCCCT GGAAGGGATA TCCCCCGAGT TGGGTCCCAC CTTGGACACA
601  CTGCAGCTGG ACGTCGCCGA CTTTGCCACC ACCATCTGGC AGCAGATGGA
651  AGAACTGGGA ATGGCCCCTG CCCTGCAGCC CACCCAGGGT GCCATGCCGG
701  CCTTCGCCTC TGCTTTCCAG CGCCGGGCAG GAGGGGTCCT GGTTGCTAGC
751  CATCTGCAGA GCTTCCTGGA GGTGTCGTAC CGCGTTCTAC GCCACCTTGC
801  GCAGCCCACA CCATTGGGCC CTGCCAGCTC CCTGCCCCAG AGCTTCCTGC
851  TCAAGTCTTT AGAGCAAGTG AGAAAGATCC AGGGCGATGG CGCAGCGCTC
901  CAGGAGAAGC TGTGTGCCAC CTAATAA
``` pMON13193

```
  1  ATGGCTAACT GCTCTATAAT GATCGATGAA ATTATACATC ACTTAAAGAG                    (SEQ ID NO:105)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTTACAAG
451  CTGTGCCACC CCGAGGAGCT GGTGCTGCTC GGACACTCTC TGGGCATCCC
501  CTGGGCTCCC CTGAGCTCCT GCCCCAGCCA GGCCCTGCAG CTGGCAGGCT
551  GCTTGAGCCA ACTCCATAGC GGCCTTTTCC TCTACCAGGG GCTCCTGCAG
601  GCCCTGGAAG GGATATCCCC CGAGTTGGGT CCCACCTTGG ACACACTGCA
651  GCTGGACGTC GCCGACTTTG CCACCACCAT CTGGCAGCAG ATGGAAGAAC
701  TGGGAATGGC CCCTGCCCTG CAGCCCACCC AGGGTGCCAT GCCGGCCTTC
751  GCCTCTGCTT TCCAGCGCCG GGCAGGAGGG GTCCTGGTTG CTAGCCATCT
801  GCAGAGCTTC CTGGAGGTGT CGTACCGCGT TCTACGCCAC CTTGCGCAGC
851  CCACACCATT GGGCCCTGCC AGCTCCCTGC CCAGAGCTT  CCTGCTCAAG
901  TCTTTAGAGC AAGTGAGAAA GATCCAGGGC GATGGCGCAG CGCTCCAGGA
951  GAAGCTGTGT GCCACCTAAT AA
``` pMON25190

TABLE 2-continued

GENE SEQUENCES

```
  1  ATGGCTAACT GCTCTATAAT GATCGATGAA ATTATACATC ACTTAAAGAG     (SEQ ID NO:106)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG GTGGTTCTGG CGGCGGCTCC AACATGGCTC
401  CCGAGTTGGG TCCCACCTTG GACACACTGC AGCTGGACGT CGCCGACTTT
451  GCCACCACCA TCTGGCAGCA GATGGAAGAA CTGGGAATGG CCCCTGCCCT
501  GCAGCCCACC CAGGGTGCCA TGCCGGCCTT CGCCTCTGCT TTCCAGCGCC
551  GGGCAGGAGG GGTCCTGGTT GCTAGCCATC TGCAGAGCTT CCTGGAGGTG
601  TCGTACCGCG TTCTACGCCA CCTTGCGCAG CCCACACCAT TGGGCCCTGC
651  CAGCTCCCTG CCCCAGAGCT TCCTGCTCAA GTCTTTAGAG CAAGTGAGAA
701  AGATCCAGGG CGATGGCGCA CGCTCCAGG AGAAGCTGTG TGCCACCTAC
751  AAGCTGTGCC ACCCCGAGGA GCTGGTGCTG CTCGGACACT CTCTGGGCAT
801  CCCCTGGGCT CCCCTGAGCT CCTGCCCCAG CCAGGCCCTG CAGCTGGCAG
851  GCTGCTTGAG CCAACTCCAT AGCGGCCTTT TCCTCTACCA GGGGCTCCTG
901  CAGGCCCTGG AAGGGATATC CTAATAA
``` pMON25191

```
  1  ATGGCTAACT GCTCTATAAT GATCGATGAA ATTATACATC ACTTAAAGAG     (SEQ ID NO:107)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTCCCGAG
451  TTGGGTCCCA CCTTGGACAC ACTGCAGCTG GACGTCGCCG ACTTTGCCAC
501  CACCATCTGG CAGCAGATGG AAGAACTGGG AATGGCCCCT GCCCTGCAGC
551  CCACCCAGGG TGCCATGCCG GCCTTCGCCT CTGCTTTCCA GCGCCGGGCA
601  GGAGGGGTCC TGGTTGCTAG CCATCTGCAG AGCTTCCTGG AGGTGTCGTA
651  CCGCGTTCTA CGCCACCTTG CGCAGCCCAC ACCATTGGGC CCTGCCAGCT
701  CCCTGCCCCA GAGCTTCCTG CTCAAGTCTT TAGAGCAAGT GAGAAAGATC
751  CAGGGCGATG GCGCAGCGCT CCAGGAGAAG CTGTGTGCCA CCTACAAGCT
801  GTGCCACCCC GAGGAGCTGG TGCTGCTCGG ACACTCTCTG GGCATCCCCT
851  GGGCTCCCCT GAGCTCCTGC CCCAGCCAGG CCCTGCAGCT GGCAGGCTGC
901  TTGAGCCAAC TCCATAGCGG CCTTTTCCTC TACCAGGGGC TCCTGCAGGC
```

TABLE 2-continued

GENE SEQUENCES

951  CCTGGAAGGG ATATCCTAAT AA pMON13194
  1  ATGGCTAACT GCTCTATAAT GATCGATGAA ATTATACATC ACTTAAAGAG         (SEQ ID NO:108)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG GTGGTTCTGG CGGCGGCTCC AACATGGCTA
401  TGGCCCCTGC CCTGCAGCCC ACCCAGGGTG CCATGCCGGC CTTCGCCTCT
451  GCTTTCCAGC GCCGGGCAGG AGGGGTCCTG GTTGCTAGCC ATCTGCAGAG
501  CTTCCTGGAG GTGTCGTACC GCGTTCTACG CCACCTTGCG CAGCCCACAC
551  CATTGGGCCC TGCCAGCTCC CTGCCCCAGA GCTTCCTGCT CAAGTCTTTA
601  GAGCAAGTGA GAAAGATCCA GGGCGATGGC GCAGCGCTCC AGGAGAAGCT
651  GTGTGCCACC TACAAGCTGT GCCACCCCGA GGAGCTGGTG CTGCTCGGAC
701  ACTCTCTGGG CATCCCCTGG GCTCCCCTGA GCTCCTGCCC CAGCCAGGCC
751  CTGCAGCTGG CAGGCTGCTT GAGCCAACTC CATAGCGGCC TTTTCCTCTA
801  CCAGGGGCTC CTGCAGGCCC TGGAAGGGAT ATCCCCCGAG TTGGGTCCCA
851  CCTTGGACAC ACTGCAGCTG GACGTCGCCG ACTTTGCCAC CACCATCTGG
901  CAGCAGATGG AAGAACTGGG ATAATAA pMON13195
  1  ATGGCTAACT GCTCTATAAT GATCGATGAA ATTATACATC ACTTAAAGAG         (SEQ ID NO:109)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTATGGCC
451  CCTGCCCTGC AGCCCACCCA GGGTGCCATG CCGGCCTTCG CCTCTGCTTT
501  CCAGCGCCGG GCAGGAGGGG TCCTGGTTGC TAGCCATCTG CAGAGCTTCC
551  TGGAGGTGTC GTACCGCGTT CTACGCCACC TTGCGCAGCC CACACCATTG
601  GGCCCTGCCA GCTCCCTGCC CCAGAGCTTC CTGCTCAAGT CTTTAGAGCA
651  AGTGAGAAAG ATCCAGGGCG ATGGCGCAGC GCTCCAGGAA AAGCTGTGTG
701  CCACCTACAA GCTGTGCCAC CCCGAGGAGC TGGTGCTGCT CGGACACTCT
751  CTGGGCATCC CCTGGGCTCC CCTGAGCTCC TGCCCCAGCC AGGCCCTGCA
801  GCTGGCAGGC TGCTTGAGCC AACTCCATAG CGGCCTTTTC CTCTACCAGG
851  GGCTCCTGCA GGCCCTGGAA GGGATATCCC CCGAGTTGGG TCCCACCTTG

TABLE 2-continued

GENE SEQUENCES

901 GACACACTGC AGCTGGACGT CGCCGACTTT GCCACCACCA TCTGGCAGCA

951 GATGGAAGAA CTGGGATAAT AA pMON13196
  1 ATGGCTAACT GCTCTATAAT GATCGATGAA ATTATACATC ACTTAAAGAG    (SEQ ID NO:110)
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA GAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTA
401 CCCAGGGTGC CATGCCGGCC TTCGCCTCTG CTTTCCAGCG CCGGGCAGGA
451 GGGGTCCTGG TTGCTAGCCA TCTGCAGAGC TTCCTGGAGG TGTCGTACCG
501 CGTTCTACGC CACCTTGCGC AGCCCACACC ATTGGGCCCT GCCAGCTCCC
551 TGCCCCAGAG CTTCCTGCTC AAGTCTTTAG AGCAAGTGAG AAAGATCCAG
601 GGCGATGGCG CAGCGCTCCA GGAGAAGCTG TGTGCCACCT ACAAGCTGTG
651 CCACCCCGAG GAGCTGGTGC TGCTCGGACA CTCTCTGGGC ATCCCCTGGG
701 CTCCCCTGAG CTCCTGCCCC AGCCAGGCCC TGCAGCTGGC AGGCTGCTTG
751 AGCCAACTCC ATAGCGGCCT TTTCCTCTAC CAGGGGCTCC TGCAGGCCCT
801 GGAAGGGATA TCCCCCGAGT TGGGTCCCAC CTTGGACACA CTGCAGCTGG
851 ACGTCGCCGA CTTTGCCACC ACCATCTGGC AGCAGATGGA AGAACTGGGA
901 ATGGCCCCTG CCCTGCAGCC CTAATAA pMON13197
  1 ATGGCTAACT GCTCTATAAT GATCGATGAA ATTATACATC ACTTAAAGAG    (SEQ ID NO:111)
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA GAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTACCCAG
451 GGTGCCATGC CGGCCTTCGC CTCTGCTTTC AGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC ACACCATTGG GCCCTGCCAG CTCCCTGCCC
601 CAGAGCTTCC TGCTCAAGTC TTTAGAGCAA GTGAGAAAGA TCCAGGGCGA
651 TGGCGCAGCG CTCCAGGAGA AGCTGTGTGC CACCTACAAG CTGTGCCACC
701 CCGAGGAGCT GGTGCTGCTC GGACACTCTC TGGGCATCCC CTGGGCTCCC
751 CTGAGCTCCT GCCCCAGCCA GGCCCTGCAG CTGGCAGGCT GCTTGAGCCA

TABLE 2-continued

| GENE SEQUENCES |
| --- |

```
801  ACTCCATAGC GGCCTTTTCC TCTACCAGGG GCTCCTGCAG GCCCTGGAAG
851  GGATATCCCC CGAGTTGGGT CCCACCTTGG ACACACTGCA GCTGGACGTC
901  GCCGACTTTG CCACCACCAT CTGGCAGCAG ATGGAAGAAC TGGGAATGGC
951  CCCTGCCCTG CAGCCCTAAT AA
``` pMON13198
```
  1  ATGGCTAACT GCTCTATAAT GATCGATGAA ATTATACATC ACTTAAAGAG        (SEQ ID NO:112)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG GTGGTTCTGG CGGCGGCTCC AACATGGCTT
401  CTGCTTTCCA GCGCCGGGCA GGAGGGGTCC TGGTTGCTAG CCATCTGCAG
451  AGCTTCCTGG AGGTGTCGTA CCGCGTTCTA CGCCACCTTG CGCAGCCCAC
501  ACCATTGGGC CCTGCCAGCT CCCTGCCCCA GAGCTTCCTG CTCAAGTCTT
551  TAGAGCAAGT GAGAAAGATC CAGGGCGATG GCGCAGCGCT CCAGGAGAAG
601  CTGTGTGCCA CCTACAAGCT GTGCCACCCC GAGGAGCTGG TGCTGCTCGG
651  ACACTCTCTG GCATCCCCT GGGCTCCCCT GAGCTCCTGC CCCAGCCAGG
701  CCCTGCAGCT GGCAGGCTGC TTGAGCCAAC TCCATAGCGG CCTTTTCCTC
751  TACCAGGGGC TCCTGCAGGC CCTGGAAGGG ATATCCCCCG AGTTGGGTCC
801  CACCTTGGAC ACACTGCAGC TGGACGTCGC CGACTTTGCC ACCACCATCT
851  GGCAGCAGAT GGAAGAACTG GGAATGGCCC CTGCCCTGCA GCCCACCCAG
901  GGTGCCATGC CGGCCTTCGC CTAATAA
``` pMON13199
```
  1  ATGGCTAACT GCTCTATAAT GATCGATGAA ATTATACATC ACTTAAAGAG        (SEQ ID NO:113)
 51  ACCACCTGCA CCTTTGCTGG ACCCGAACAA CCTCAATGAC GAAGACGTCT
101  CTATCCTGAT GGACCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTTCTGCT
451  TTCCAGCGCC GGGCAGGAGG GGTCCTGGTT GCTAGCCATC TGCAGAGCTT
501  CCTGGAGGTG TCGTACCGCG TTCTACGCCA CCTTGCGCAG CCCACACCAT
551  TGGGCCCTGC AGCTCCCTG CCCCAGAGCT TCCTGCTCAA GTCTTTAGAG
601  CAAGTGAGAA AGATCCAGGG CGATGGCGCA GCGCTCCAGG AGAAGCTGTG
651  TGCCACCTAC AAGCTGTGCC ACCCCGAGGA GCTGGTGCTG CTCGGACACT
701  CTCTGGGCAT CCCCTGGGCT CCCCTGAGCT CCTGCCCCAG CCAGGCCCTG
```

TABLE 2-continued

GENE SEQUENCES

```
751  CAGCTGGCAG GCTGCTTGAG CCAACTCCAT AGCGGCCTTT TCCTCTACCA
801  GGGGCTCCTG CAGGCCCTGG AAGGGATATC CCCCGAGTTG GGTCCCACCT
851  TGGACACACT GCAGCTGGAC GTCGCCGACT TTGCCACCAC CATCTGGCAG
901  CAGATGGAAG AACTGGGAAT GGCCCCTGCC CTGCAGCCCA CCCAGGGTGC
951  CATGCCGGCC TTCGCCTAAT AA
``` pMON31112
```
  1  ATGGCTAACT GCTCTAACAT GATCGATGAA ATCATCACCC ACCTGAAGCA     (SEQ ID NO:114)
 51  GCCACCGCTG CCGCTGCTGG ACTTCAACAA CCTCAATGGT GAAGACCAAG
101  ATATCCTAAT GGACAATAAC CTTCGTCGTC CAAACCTCGA GGCATTCAAC
151  CGTGCTGTCA AGTCTCTGCA GAATGCATCA GCAATTGAGA GCATTCTTAA
201  AAATCTCCTG CCATGTCTGC CGCTAGCCAC GGCCGCACCC ACGCGACATC
251  CAATCCATAT CAAGGACGGT GACTGGAATG AATTCCGTCG TAAACTGACC
301  TTCTATCTGA AAACCTTGGA GAACGCGCAG GCTCAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTACCCAG
451  GGTGCCATGC CGGCCTTCGC CTCTGCTTTC AGCGCCGGG CAGGAGGGGT
501  CCTGGTTGCT AGCCATCTGC AGAGCTTCCT GGAGGTGTCG TACCGCGTTC
551  TACGCCACCT TGCGCAGCCC TCTGGCGGCT CTGGCGGCTC TCAGAGCTTC
601  CTGCTCAAGT CTTTAGAGCA AGTGAGAAAG ATCCAGGGCG ATGGCGCAGC
651  GCTCCAGGAG AAGCTGTGTG CCACCTACAA GCTGTGCCAC CCCGAGGAGC
701  TGGTGCTGCT CGGACACTCT CTGGGCATCC CCTGGGCTCC CCTGAGCTCC
751  TGCCCCAGCC AGGCCCTGCA GCTGGCAGGC TGCTTGAGCC AACTCCATAG
801  CGGCCTTTTC CTCTACCAGG GGCTCCTGCA GGCCCTGGAA GGGATATCCC
851  CCGAGTTGGG TCCCACCTTG ACACACTGC AGCTGGACGT CGCCGACTTT
901  GCCACCACCA TCTGGCAGCA GATGGAAGAA CTGGGAATGG CCCCTGCCCT
951  GCAGCCCTAA TAA
``` pMON31113
```
  1  ATGGCTAACT GCTCTAACAT GATCGATGAA ATCATCACCC ACCTGAAGCA     (SEQ ID NO:115)
 51  GCCACCGCTG CCGCTGCTGG ACTTCAACAA CCTCAATGGT GAAGACCAAG
101  ATATCCTGAT GGAAAATAAC CTTCGTCGTC CAAACCTCGA GGCATTCAAC
151  CGTGCTGTCA AGTCTCTGCA GAATGCATCA GCAATTGAGA GCATTCTTAA
201  AAATCTCCTG CCATGTCTGC CCCTGGCCAC GGCCGCACCC ACGCGACATC
251  CAATCATCAT CCGTGACGGT GACTGGAATG AATTCCGTCG TAAACTGACC
301  TTCTATCTGA AAACCTTGGA GAACGCGCAG GCTCAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTACCCAG
451  GGTGCCATGC CGGCCTTCGC CTCTGCTTTC AGCGCCGGG CAGGAGGGGT
501  CCTGGTTGCT AGCCATCTGC AGAGCTTCCT GGAGGTGTCG TACCGCGTTC
551  TACGCCACCT TGCGCAGCCC ACACCATTGG GCCCTGCCAG CTCCCTGCCC
```

TABLE 2-continued

GENE SEQUENCES

```
601  CAGAGCTTCC TGCTCAAGTC TTTAGAGCAA GTGAGAAAGA TCCAGGGCGA
651  TGGCGCAGCG CTCCAGGAGA AGCTGTGTGC CACCTACAAG CTGTGCCACC
701  CCGAGGAGCT GGTGCTGCTC GGACACTCTC TGGGCATCCC CTGGGCTCCC
751  CTGAGCTCCT GCCCCAGCCA GGCCCTGCAG CTGGCAGGCT GCTTGAGCCA
801  ACTCCATAGC GGCCTTTTCC TCTACCAGGG GCTCCTGCAG GCCCTGGAAG
851  GGATATCCCC CGAGTTGGGT CCCACCTTGG ACACACTGCA GCTGGACGTC
901  GCCGACTTTG CCACCACCAT CTGGCAGCAG ATGGAAGAAC TGGGAATGGC
951  CCCTGCCCTG CAGCCCTAAT AA
``` pMON31114
```
  1  ATGGCTAACT GCTCTAACAT GATCGATGAA ATCATCACCC ACCTGAAGCA       (SEQ ID NO:116)
 51  GCCACCGCTG CCGCTGCTGG ACTTCAACAA CCTCAATGGT GAAGACCAAG
101  ATATCCTGAT GGAAAATAAC CTTCGTCGTC CAAACCTCGA GGCATTCAAC
151  CGTGCTGTCA AGTCTCTGCA GAATGCATCA GCAATTGAGA GCATTCTTAA
201  AAATCTCCTG CCATGTCTGC CCCTGGCCAC GGCCGCACCC ACGCGACATC
251  CAATCATCAT CCGTGACGGT GACTGGAATG AATTCCGTCG TAAACTGACC
301  TTCTATCTGA AAACCTTGGA GAACGCGCAG GCTCAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTACCCAG
451  GGTGCCATGC CGGCCTTCGC CTCTGCTTTC CAGCGCCGGG CAGGAGGGGT
501  CCTGGTTGCT AGCCATCTGC AGAGCTTCCT GGAGGTGTCG TACCGCGTTC
551  TACGCCACCT TGCGCAGCCC TCTGGCGGCT CTGGCGGCTC TCAGAGCTTC
601  CTGCTCAAGT CTTTAGAGCA AGTGAGAAAG ATCCAGGGCG ATGGCGCAGC
651  GCTCCAGGAG AAGCTGTGTG CCACCTACAA GCTGTGCCAC CCCGAGGAGC
701  TGGTGCTGCT CGGACACTCT CTGGGCATCC CCTGGGCTCC CCTGAGCTCC
751  TGCCCCAGCC AGGCCCTGCA GCTGGCAGGC TGCTTGAGCC AACTCCATAG
801  CGGCCTTTTC CTCTACCAGG GGCTCCTGCA GGCCCTGGAA GGGATATCCC
851  CCGAGTTGGG TCCCACCTTG GACACACTGC AGCTGGACGT CGCCGACTTT
901  GCCACCACCA TCTGGCAGCA GATGGAAGAA CTGGGAATGG CCCCTGCCCT
951  GCAGCCCTAA TAA
``` pMON31115
```
  1  ATGGCTAACT GCTCTAACAT GATCGATGAA ATCATCACCC ACCTGAAGCA       (SEQ ID NO:117)
 51  GCCACCGCTG CCGCTGCTGG ACTTCAACAA CCTCAATGGT GAAGACCAAG
101  ATATCCTAAT GGACAATAAC CTTCGTCGTC CAAACCTCGA GGCATTCAAC
151  CGTGCTGTCA AGTCTCTGCA GAATGCATCA GCAATTGAGA GCATTCTTAA
201  AAATCTCCTG CCATGTCTGC CGCTAGCCAC GGCCGCACCC ACGCGACATC
251  CAATCCATAT CAAGGACGGT GACTGGAATG AATTCCGTCG TAAACTGACC
301  TTCTATCTGA AAACCTTGGA GAACGCGCAG GCTCAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTACCCAG
451  GGTGCCATGC CGGCCTTCGC CTCTGCTTTC CAGCGCCGGG CAGGAGGGGT
```

TABLE 2-continued

GENE SEQUENCES

```
501  CCTGGTTGCT AGCCATCTGC AGAGCTTCCT GGAGGTGTCG TACCGCGTTC
551  TACGCCACCT TGCGCAGCCC ACACCATTGG GCCCTGCCAG CTCCCTGCCC
601  CAGAGCTTCC TGCTCAAGTC TTTAGAGCAA GTGAGAAAGA TCCAGGGCGA
651  TGGCGCAGCG CTCCAGGAGA AGCTGTGTGC CACCTACAAG CTGTGCCACC
701  CCGAGGAGCT GGTGCTGCTC GGACACTCTC TGGGCATCCC CTGGGCTCCC
751  CTGAGCTCCT GCCCCAGCCA GGCCCTGCAG CTGGCAGGCT GCTTGAGCCA
801  ACTCCATAGC GGCCTTTTCC TCTACCAGGG GCTCCTGCAG GCCCTGGAAG
851  GGATATCCCC CGAGTTGGGT CCCACCTTGG ACACACTGCA GCTGGACGTC
901  GCCGACTTTG CCACCACCAT CTGGCAGCAG ATGGAAGAAC TGGGAATGGC
951  CCCTGCCCTG CAGCCCTAAT AA
``` pMON28505
GCTAACTGCTCTATAATGATCGATGAAATTATACATCACTTAAAGAGACCACCTGCACCTTTGCTGG        (SEQ ID NO:118)
ACCCGAACAACCTCAATGACGAAGACGTCTCTATCCTGATGGACCGAAACCTTCGACTTCCAAACCT
GGAGAGCTTCGTAAGGGCTGTCAAGAACTTAGAAAATGCATCAGGTATTGAGGCAATTCTTCGTAAT
CTCCAACCATGTCTGCCCTCTGCCACGGCCGCACCCTCTCGACATCCAATCATCATCAAGGCAGGTG
ACTGGCAAGAATTCCGGGAAAAACTGACGTTCTATCTGGTTACCCTTGAGCAAGCGCAGGAACAACA
GTACGTAGAGGGCGGTGGAGGCTCCCCGGGTGAACCGTCTGGTCCAATCTCTACTATCAACCCGTCT
CCTCCGTCTAAAGAATCTCATAAATCTCCAAACATGGAGGTTCACCCTTTGCCTACACCTGTCCTGC
TGCCTGCTGTGGACTTTAGCTTGGGAGAATGGAAAACCCAGATGGAGGAGACCAAGGCACAGGACAT
TCTGGGAGCAGTGACCCTTCTGCTGGAGGGAGTGATGGCAGCACGGGACAACTGGGACCCACTTGC
CTCTCATCCCTCCTGGGGCAGCTTTCTGGACAGGTCCGTCTCCTCCTTGGGGCCCTGCAGAGCCTCC
TTGGAACCCAGCTTCCTCCACAGGGCAGGACCACAGCTCACAAGGATCCCAATGCCATCTTCCTGAG
CTTCCAACACCTGCTCCGAGGAAAGGTGCGTTTCCTGATGCTTGTAGGAGGGTCCACCCTCTGCGTC
AGGGAATTCGGCGGCAACATGGCGTCTCCCGCTCCGCCTGCTTGTGACCTCCGAGTCCTCAGTAAAC
TGCTTCGTGACTCCCATGTCCTTCACAGCAGACTGAGCCAGTGCCCA pMON28506
GCTAACTGCTCTATAATGATCGATGAAATTATACATCACTTAAAGAGACCACCTGCACCTTTGCTGG        (SEQ ID NO:119)
ACCCGAACAACCTCAATGACGAAGACGTCTCTATCCTGATGGACCGAAACCTTCGACTTCCAAACCT
GGAGAGCTTCGTAAGGGCTGTCAAGAACTTAGAAAATGCATCAGGTATTGAGGCAATTCTTCGTAAT
CTCCAACCATGTCTGCCCTCTGCCACGGCCGCACCCTCTCGACATCCAATCATCATCAAGGCAGGTG
ACTGGCAAGAATTCCGGGAAAAACTGACGTTCTATCTGGTTACCCTTGAGCAAGCGCAGGAACAACA
GTACGTAGAGGGCGGTGGAGGCTCCCCGGGTGAACCGTCTGGTCCAATCTCTACTATCAACCCGTCT
CCTCCGTCTAAAGAATCTCATAAATCTCCAAACATGTTGCCTACACCTGTCCTGCTGCCTGCTGTGG
ACTTTAGCTTGGGAGAATGGAAAACCCAGATGGAGGAGACCAAGGCACAGGACATTCTGGGAGCAGT
GACCCTTCTGCTGGAGGGAGTGATGGCAGCACGGGACAACTGGGACCCACTTGCCTCTCATCCCTC
CTGGGGCAGCTTTCTGGACAGGTCCGTCTCCTCCTTGGGGCCCTGCAGAGCCTCCTTGGAACCCAGC
TTCCTCCACAGGGCAGGACCACAGCTCACAAGGATCCCAATGCCATCTTCCTGAGCTTCCAACACCT
GCTCCGAGGAAAGGTGCGTTTCCTGATGCTTGTAGGAGGGTCCACCCTCTGCGTCAGGGAATTCGGC
GGCAACATGGCGTCTCCCGCTCCGCCTGCTTGTGACCTCCGAGTCCTCAGTAAACTGCTTCGTGACT

TABLE 2-continued

GENE SEQUENCES

CCCATGTCCTTCACAGCAGACTGAGCCAGTGCCCAGAGGTTCACCCT pMON28507
GCTAACTGCTCTATAATGATCGATGAAATTATACATCACTTAAAGAGACCACCTGCACCTTTGCTGG (SEQ ID NO:120)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGTCCTGCTGCCTGCTGTGGACTTTAGCTTGG

GAGAATGGAAAACCCAGATGGAGGAGACCAAGGCACAGGACATTCTGGGAGCAGTGACCCTTCTGCT

GGAGGGAGTGATGGCAGCACGGGACAACTGGGACCCACTTGCCTCTCATCCCTCCTGGGGCAGCTT

TCTGGACAGGTCCGTCTCCTCCTTGGGGCCCTGCAGAGCCTCCTTGGAACCCAGCTTCCTCCACAGG

GCAGGACCACAGCTCACAAGGATCCCAATGCCATCTTCCTGAGCTTCCAACACCTGCTCCGAGGAAA

GGTGCGTTTCCTGATGCTTGTAGGAGGGTCCACCCTCTGCGTCAGGGAATTCGGCGGCAACATGGCG

TCTCCCGCTCCGCCTGCTTGTGACCTCCGAGTCCTCAGTAAACTGCTTCGTGACTCCCATGTCCTTC

ACAGCAGACTGAGCCAGTGCCCAGAGGTTCACCCTTTGCCTACACCT pMON28508
GCTAACTGCTCTATAATGATCGATGAAATTATACATCACTTAAAGAGACCACCTGCACCTTTGCTGG (SEQ ID NO:121)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCTGTGGACTTTAGCTTGGGAGAATGGAAAA

CCCAGATGGAGGAGACCAAGGCACAGGACATTCTGGGAGCAGTGACCCTTCTGCTGGAGGGAGTGAT

GGCAGCACGGGACAACTGGGACCCACTTGCCTCTCATCCCTCCTGGGGCAGCTTTCTGGACAGGTC

CGTCTCCTCCTTGGGGCCCTGCAGAGCCTCCTTGGAACCCAGCTTCCTCCACAGGGCAGGACCACAG

CTCACAAGGATCCCAATGCCATCTTCCTGAGCTTCCAACACCTGCTCCGAGGAAAGGTGCGTTTCCT

GATGCTTGTAGGAGGGTCCACCCTCTGCGTCAGGGAATTCGGCGGCAACATGGCGTCTCCCGCTCCG

CCTGCTTGTGACCTCCGAGTCCTCAGTAAACTGCTTCGTGACTCCCATGTCCTTCACAGCAGACTGA

GCCAGTGCCCAGAGGTTCACCCTTTGCCTACACCTGTCCTGCTGCCT pMON28509
GCTAACTGCTCTATAATGATCGATGAAATTATACATCACTTAAAGAGACCACCTGCACCTTTGCTGG (SEQ ID NO:122)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGACTTTAGCTTGGGAGAATGGAAAACCCAGA

TGGAGGAGACCAAGGCACAGGACATTCTGGGAGCAGTGACCCTTCTGCTGGAGGGAGTGATGGCAGC

TABLE 2-continued

GENE SEQUENCES

ACGGGGACAACTGGGACCCACTTGCCTCTCATCCCTCCTGGGGCAGCTTTCTGGACAGGTCCGTCTC

CTCCTTGGGGCCCTGCAGAGCCTCCTTGGAACCCAGCTTCCTCCACAGGGCAGGACCACAGCTCACA

AGGATCCCAATGCCATCTTCCTGAGCTTCCAACACCTGCTCCGAGGAAAGGTGCGTTTCCTGATGCT

TGTAGGAGGGTCCACCCTCTGCGTCAGGGAATTCGGCGGCAACATGGCGTCTCCCGCTCCGCCTGCT

TGTGACCTCCGAGTCCTCAGTAAACTGCTTCGTGACTCCCATGTCCTTCACAGCAGACTGAGCCAGT

GCCCAGAGGTTCACCCTTTGCCTACACCTGTCCTGCTGCCTGCTGTG pMON28510
GCTAACTGCTCTATAATGATCGATGAAATTATACATCACTTAAAGAGACCACCTGCACCTTTGCTGG (SEQ ID NO:123)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCGGTTACCCTTGAGCAAGCGCAGGAACAACAG

TACGTAGAGGGCGGTGGAGGCTCCCCGGGGAACCGTCTGGTCCAATCTCTACTATCAACCCGTCTCC

TCCGTCTAAAGAATCTCATAAACTCCAAACATGGGAGAATGGAAAACCCAGATGGAGGAGACCAAGG

CACAGGACATTCTGGAGCAGTGACCCTTCTGCTGGAGGGAGTGATGGCAGCACGGGACAACTGGGA

CCCACTTGCTCTCATCCCTCCTGGGGCAGCTTTCTGGACAGGTCCGTCTCCTCCTTGGGGCCCTGCA

GGCCTCCTTGGAACCCAGCTTCCTCCACAGGGCAGGACCACAGCTCACAAGGATCCCAATGCATCTT

CCTGAGCTTCCAACACCTGCTCCGAGGAAAGGTGCGTTTCCTGATGCTTGTAGGGGTCCACCCTCT

GCGTCAGGGAATTCGGCGGCAACATGGCGTCTCCCGCTCCGCCTGCTGTGACCTCCGAGTCCTCAGT

AAACTGCTTCGTGACTCCCATGTCCTTCACAGCAGACTGACCAGTGCCCAGAGGTTCACCCTTTGCC

TACACCTGTCCTGCTGCCTGCTGTGGACTTTAGTTG pMON28511
GCTAACTGCTCTATAATGATCGATGAAATTATACATCACTTAAAGAGACCACCTGCACCTTTGCTGG (SEQ ID NO:124)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGACCCACTTGCCTCTCATCCCTCCTGGGGC

AGCTTTCTGGACAGGTCCGTCCTCCTTGGGGCCCTGCAGAGCCTCCTTGGAACCCAGCTTCCTCC

ACAGGGCAGGACCACAGCTCACAAGGATCCCAATGCCATCTTCCTGAGCTTCCAACACCTGCTCCGA

GGAAAGGTGCGTTTCCTGATGCTTGTAGGAGGGTCCACCCTCTGCGTCAGGGAATTCGGCGGCAACA

TGGCGTCTCCCGCTCCGCCTGCTTGTGACCTCCGAGTCCTCAGTAAACTGCTTCGTGACTCCCATGT

CCTTCACAGCAGACTGAGCCAGTGCCCAGAGGTTCACCCTTTGCCTACACCTGTCCTGCTGCCTGCT

GTGGACTTTAGCTTGGGAGAATGGAAAACCCAGATGGAGGAGACCAAGGCACAGGACATTCTGGGAG

CAGTGACCCTTCTGCTGGAGGGAGTGATGGCAGCACGGGACAACTG pMON28512
GCTAACTGCTCTATAATGATCGATGAAATTATACATCACTTAAAGAGACCACCTGCACCTTTGCTGG (SEQ ID NO:125)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

TABLE 2-continued

GENE SEQUENCES

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGAACCCAGCTTCCTCCACAGGGCAGGACCA

CAGCTCACAAGGATCCCAATGCCATCTTCCTGAGCTTCCAACACCTGCTCCGAGGAAAGGTGCGTTT

CCTGATGCTTGTAGGAGGGTCCACCCTCTGCGTCAGGGAATTCGGCGGCAACATGGCGTCTCCCGCT

CCGCCTGCTTGTGACCTCCGAGTCCTCAGTAAACTGCTTCGTGACTCCCATGTCCTTCACAGCAGAC

TGAGCCAGTGCCCAGAGGTTCACCCTTTGCCTACACCTGTCCTGCTGCCTGCTGTGGACTTTAGCTT

GGGAGAATGGAAAACCCAGATGGAGGAGACCAAGGCACAGGACATTCTGGGAGCAGTGACCCTTCTG

CTGGAGGGAGTGATGGCAGCACGGGGACAACTGGGACCCACTTGCCTCTCATCCCTCCTGGGGCAGC

TTTCTGGACAGGTCCGTCTCCTCCTTGGGGCCCTGCAGAGCCTCCTT pMON28513
GCTAACTGCTCTATAATGATCGATGAAATTATACATCACTTAAAGAGACCACCTGCACCTTTGCTGG    (SEQ ID NO:126)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGCAGGACCACAGCTCACAAGGATCCCAATG

CCATCTTCCTGAGCTTCCAACACCTGCTCCGAGGAAAGGTGCGTTTCCTGATGCTTGTAGGAGGGTC

CACCCTCTGCGTCAGGGAATTCGGCGGCAACATGGCGTCTCCCGCTCCGCCTGCTTGTGACCTCCGA

GTCCTCAGTAAACTGCTTCGTGACTCCCATGTCCTTCACAGCAGACTGAGCCAGTGCCCAGAGGTTC

ACCCTTTGCCTACACCTGTCCTGCTGCCTGCTGTGGACTTTAGCTTGGGAGAATGGAAAACCCAGAT

GGAGGAGACCAAGGCACAGGACATTCTGGGAGCAGTGACCCTTCTGCTGGAGGGAGTGATGGCAGCA

CGGGGACAACTGGGACCCACTTGCCTCTCATCCCTCCTGGGGCAGCTTTCTGGACAGGTCCGTCTCC

TCCTTGGGGCCCTGCAGAGCCTCCTTGGAACCCAGCTTCCTCCACAG pMON28514
GCTAACTGCTCTATAATGATCGATGAAATTATACATCACTTAAAGAGACCACCTGCACCTTTGCTGG    (SEQ ID NO:127)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCTCACAAGGATCCCAATGCCATCTTCCTGA

GCTTCCAACACCTGCTCCGAGGAAAGGTGCGTTTCCTGATGCTTGTAGGAGGGTCCACCCTCTGCGT

CAGGGAATTCGGCGGCAACATGGCGTCTCCCGCTCCGCCTGCTTGTGACCTCCGAGTCCTCAGTAAA

CTGCTTCGTGACTCCCATGTCCTTCACAGCAGACTGAGCCAGTGCCCAGAGGTTCACCCTTTGCCTA

CACCTGTCCTGCTGCCTGCTGTGGACTTTAGCTTGGGAGAATGGAAAACCCAGATGGAGGAGACCAA

GGCACAGGACATTCTGGGAGCAGTGACCCTTCTGCTGGAGGGAGTGATGGCAGCACGGGGACAACTG

GGACCCACTTGCCTCTCATCCCTCCTGGGGCAGCTTTCTGGACAGGTCCGTCTCCTCCTTGGGGCCC

TABLE 2-continued

GENE SEQUENCES

TGCAGAGCCTCCTTGGAACCCAGCTTCCTCCACAGGGCAGGACCACA pMON28515
GCTAACTGCTCTATAATGATCGATGAAATTATACATCACTTAAAGAGACCACCTGCACCTTTGCTGG (SEQ ID NO:128)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGATCCCAATGCCATCTTCCTGAGCTTCCAAC

ACCTGCTCCGAGGAAAGGTGCGTTTCCTGATGCTTGTAGGAGGGTCCACCCTCTGCGTCAGGGAATT

CGGCGGCAACATGGCGTCTCCCGCTCCGCCTGCTTGTGACCTCCGAGTCCTCAGTAAACTGCTTCGT

GACTCCCATGTCCTTCACAGCAGACTGAGCCAGTGCCCAGAGGTTCACCCTTTGCCTACACCTGTCC

TGCTGCCTGCTGTGGACTTTAGCTTGGGAGAATGGAAAACCCAGATGGAGGAGACCAAGGCACAGGA

CATTCTGGGAGCAGTGACCCTTCTGCTGGAGGGAGTGATGGCAGCACGGGGACAACTGGGACCCACT

TGCCTCTCATCCCTCCTGGGGCAGCTTTCTGGACAGGTCCGTCTCCTCCTTGGGGCCCTGCAGAGCC

TCCTTGGAACCCAGCTTCCTCCACAGGGCAGGACCACAGCTCACAAG pMON28516
GCTAACTGCTCTATAATGATCGATGAAATTATACATCACTTAAAGAGACCACCTGCACCTTTGCTGG (SEQ ID NO:129)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCCATCTTCCTGAGCTTCCAACACCTGCTCC

GAGGAAAGGTGCGTTTCCTGATGCTTGTAGGAGGGTCCACCCTCTGCGTCAGGGAATTCGGCGGCAA

CATGGCGTCTCCCGCTCCGCCTGCTTGTGACCTCCGAGTCCTCAGTAAACTGCTTCGTGACTCCCAT

GTCCTTCACAGCAGACTGAGCCAGTGCCCAGAGGTTCACCCTTTGCCTACACCTGTCCTGCTGCCTG

CTGTGGACTTTAGCTTGGGAGAATGGAAAACCCAGATGGAGGAGACCAAGGCACAGGACATTCTGGG

AGCAGTGACCCTTCTGCTGGAGGGAGTGATGGCAGCACGGGGACAACTGGGACCCACTTGCCTCTCA

TCCCTCCTGGGGCAGCTTTCTGGACAGGTCCGTCTCCTCCTTGGGGCCCTGCAGAGCCTCCTTGGAA

CCCAGCTTCCTCCACAGGGCAGGACCACAGCTCACAAGGATCCCAAT pMON28519
GCTAACTGCTCTATAATGATCGATGAAATTATACATCACTTAAAGAGACCACCTGCACCTTTGCTGG (SEQ ID NO:130)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGAGGTTCACCCTTTGCCTACACCTGTCCTGC

TGCCTGCTGTGGACTTTAGCTTGGGAGAATGGAAAACCCAGATGGAGGAGACCAAGGCACAGGACAT

TABLE 2-continued

GENE SEQUENCES

TCTGGGAGCAGTGACCCTTCTGCTGGAGGGAGTGATGGCAGCACGGGGACAACTGGGACCCACTTGC

CTCTCATCCCTCCTGGGGCAGCTTTCTGGACAGGTCCGTCTCCTCCTTGGGGCCCTGCAGAGCCTCC

TTGGAACCCAGCTTCCTCCACAGGGCAGGACCACAGCTCACAAGGATCCCAATGCCATCTTCCTGAG

CTTCCAACACCTGCTCCGAGGAAAGGTGCGTTTCCTGATGCTTGTAGGAGGGTCCACCCTCTGCGTC

AGGGAATTCGGCAACATGGCGTCTCCCGCTCCGCCTGCTTGTGACCTCCGAGTCCTCAGTAAACTGC

TTCGTGACTCCCATGTCCTTCACAGCAGACTGAGCCAGTGCCCA pMON28520
GCTAACTGCTCTATAATGATCGATGAAATTATACATCACTTAAAGAGACCACCTGCACCTTTGCTGG    (SEQ ID NO:131)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGTTGCCTACACCTGTCCTGCTGCCTGCTGTGG

ACTTTAGCTTGGGAGAATGGAAAACCCAGATGGAGGAGACCAAGGCACAGGACATTCTGGGAGCAGT

GACCCTTCTGCTGGAGGGAGTGATGGCAGCACGGGGACAACTGGGACCCACTTGCCTCTCATCCCTC

CTGGGGCAGCTTTCTGGACAGGTCCGTCTCCTCCTTGGGGCCCTGCAGAGCCTCCTTGGAACCCAGC

TTCCTCCACAGGGCAGGACCACAGCTCACAAGGATCCCAATGCCATCTTCCTGAGCTTCCAACACCT

GCTCCGAGGAAAGGTGCGTTTCCTGATGCTTGTAGGAGGGTCCACCCTCTGCGTCAGGGAATTCGGC

AACATGGCGTCTCCCGCTCCGCCTGCTTGTGACCTCCGAGTCCTCAGTAAACTGCTTCGTGACTCCC

ATGTCCTTCACAGCAGACTGAGCCAGTGCCCAGAGGTTCACCCT pMON28521
GCTAACTGCTCTATAATGATCGATGAAATTATACATCACTTAAAGAGACCACCTGCACCTTTGCTGG    (SEQ ID NO:132)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGTCCTGCTGCCTGCTGTGGACTTTAGCTTGG

GAGAATGGAAAACCCAGATGGAGGAGACCAAGGCACAGGACATTCTGGGAGCAGTGACCCTTCTGCT

GGAGGGAGTGATGGCAGCACGGGGACAACTGGGACCCACTTGCCTCTCATCCCTCCTGGGGCAGCTT

TCTGGACAGGTCCGTCTCCTCCTTGGGGCCCTGCAGAGCCTCCTTGGAACCCAGCTTCCTCCACAGG

GCAGGACCACAGCTCACAAGGATCCCAATGCCATCTTCCTGAGCTTCCAACACCTGCTCCGAGGAAA

GGTGCGTTTCCTGATGCTTGTAGGAGGGTCCACCCTCTGCGTCAGGGAATTCGGCAACATGGCGTCT

CCCGCTCCGCCTGCTTGTGACCTCCGAGTCCTCAGTAAACTGCTTCGTGACTCCCATGTCCTTCACA

GCAGACTGAGCCAGTGCCCAGAGGTTCACCCTTTGCCTACACCT pMON28522
GCTAACTGCTCTATAATGATCGATGAAATTATACATCACTTAAAGAGACCACCTGCACCTTTGCTGG    (SEQ ID NO:133)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

TABLE 2-continued

GENE SEQUENCES

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCTGTGGACTTTAGCTTGGGAGAATGGAAAA

CCCAGATGGAGGAGACCAAGGCACAGGACATTCTGGGAGCAGTGACCCTTCTGCTGGAGGGAGTGAT

GGCAGCACGGGACAACTGGGACCCACTTGCCTCTCATCCCTCCTGGGGCAGCTTTCTGGACAGGTC

CGTCTCCTCCTTGGGGCCCTGCAGAGCCTCCTTGGAACCCAGCTTCCTCCACAGGGCAGGACCACAG

CTCACAAGGATCCCAATGCCATCTTCCTGAGCTTCCAACACCTGCTCCGAGGAAAGGTGCGTTTCCT

GATGCTTGTAGGAGGGTCCACCCTCTGCGTCAGGGAATTCGGCAACATGGCGTCTCCCGCTCCGCCT

GCTTGTGACCTCCGAGTCCTCAGTAAACTGCTTCGTGACTCCCATGTCCTTCACAGCAGACTGAGCC

AGTGCCCAGAGGTTCACCCTTTGCCTACACCTGTCCTGCTGCCT pMON28523
GCTAACTGCTCTATAATGATCGATGAAATTATACATCACTTAAAGAGACCACCTGCACCTTTGCTGG (SEQ ID NO:134)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCdGTGGAGGCTCCCCGGGTGAACCGTCTGGTCCAATCTCTACTATCAACCCGTCT

CCTCCGTCTAAAGAATCTCATAAATCTCCAAACATGGACTTTAGCTTGGGAGAATGGAAAACCCAGA

TGGAGGAGACCAAGGCACAGGACATTCTGGGAGCAGTGACCCTTCTGCTGGAGGGAGTGATGGCAGC

ACGGGACAACTGGGACCCACTTGCCTCTCATCCCTCCTGGGGCAGCTTTCTGGACAGGTCCGTCTC

CTCCTTGGGGCCCTGCAGAGCCTCCTTGGAACCCAGCTTCCTCCACAGGGCAGGACCACAGCTCACA

AGGATCCCAATGCCATCTTCCTGAGCTTCCAACACCTGCTCCGAGGAAAGGTGCGTTTCCTGATGCT

TGTAGGAGGGTCCACCCTCTGCGTCAGGGAATTCGGCAACATGGCGTCTCCCGCTCCGCCTGCTTGT

GACCTCCGAGTCCTCAGTAAACTGCTTCGTGACTCCCATGTCCTTCACAGCAGACTGAGCCAGTGCC

CAGAGGTTCACCCTTTGCCTACACCTGTCCTGCTGCCTGCTGTG pMON28524
GCTAACTGCTCTATAATGATCGATGAAATTATACATCACTTAAAGAGACCACCTGCACCTTTGCTGG (SEQ ID NO:135)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGAGAATGGAAAACCCAGATGGAGGAGACCA

AGGCACAGGACATTCTGGGAGCAGTGACCCTTCTGCTGGAGGGAGTGATGGCAGCACGGGACAACT

GGGACCCACTTGCCTCTCATCCCTCCTGGGGCAGCTTTCTGGACAGGTCCGTCTCCTCCTTGGGGCC

CTGCAGAGCCTCCTTGGAACCCAGCTTCCTCCACAGGGCAGGACCACAGCTCACAAGGATCCCAATG

CCATCTTCCTGAGCTTCCAACACCTGCTCCGAGGAAAGGTGCGTTTCCTGATGCTTGTAGGAGGGTC

CACCCTCTGCGTCAGGGAATTCGGCAACATGGCGTCTCCCGCTCCGCCTGCTTGTGACCTCCGAGTC

TABLE 2-continued

GENE SEQUENCES

CTCAGTAAACTGCTTCGTGACTCCCATGTCCTTCACAGCAGACTGAGCCAGTGCCCAGAGGTTCACC

CTTTGCCTACACCTGTCCTGCTGCCTGCTGTGGACTTTAGCTTG pMON28525
GCTAACTGCTCTATAATGATCGATGAAATTATACATCACTTAAAGAGACCACCTGCACCTTTGCTGG (SEQ ID NO:136)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGACCCACTTGCCTCTCATCCCTCCTGGGGC

AGCTTTCTGGACAGGTCCGTCTCCTCCTTGGGGCCCTGCAGAGCCTCCTTGGAACCCAGCTTCCTCC

ACAGGGCAGGACCACAGCTCACAAGGATCCCAATGCCATCTTCCTGAGCTTCCAACACCTGCTCCGA

GGAAAGGTGCGTTTCCTGATGCTTGTAGGAGGGTCCACCCTCTGCGTCAGGGAATTCGGCAACATGG

CGTCTCCCGCTCCGCCTGCTTGTGACCTCCGAGTCCTCAGTAAACTGCTTCGTGACTCCCATGTCCT

TCACAGCAGACTGAGCCAGTGCCCAGAGGTTCACCCTTTGCCTACACCTGTCCTGCTGCCTGCTGTG

GACTTTAGCTTGGGAGAATGGAAAACCCAGATGGAGGAGACCAAGGCACAGGACATTCTGGGAGCAG

TGACCCTTCTGCTGGAGGGAGTGATGGCAGCACGGGACAACTG pMON28526
GCTAACTGCTCTATAATGATCGATGAAATTATACATCACTTAAAGAGACCACCTGCACCTTTGCTGG (SEQ ID NO:137)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGAACCCAGCTTCCTCCACAGGGCAGGACCA

CAGCTCACAAGGATCCCAATGCCATCTTCCTGAGCTTCCAACACCTGCTCCGAGGAAAGGTGCGTTT

CCTGATGCTTGTAGGAGGGTCCACCCTCTGCGTCAGGGAATTCGGCAACATGGCGTCTCCCGCTCCG

CCTGCTTGTGACCTCCGAGTCCTCAGTAAACTGCTTCGTGACTCCCATGTCCTTCACAGCAGACTGA

GCCAGTGCCCAGAGGTTCACCCTTTGCCTACACCTGTCCTGCTGCCTGCTGTGGACTTTAGCTTGGG

AGAATGGAAAACCCAGATGGAGGAGACCAAGGCACAGGACATTCTGGGAGCAGTGACCCTTCTGCTG

GAGGGAGTGATGGCAGCACGGGACAACTGGGACCCACTTGCCTCTCATCCCTCCTGGGGCAGCTTT

CTGGACAGGTCCGTCTCCTCCTTGGGGCCCTGCAGAGCCTCCTT pMON28527
GCTAACTGCTCTATAATGATCGATGAAATTATACATCACTTAAAGAGACCACCTGCACCTTTGCTGG (SEQ ID NO:138)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGCAGGACCACAGCTCACAAGGATCCCAATG

TABLE 2-continued

GENE SEQUENCES

CCATCTTCCTGAGCTTCCAACACCTGCTCCGAGGAAAGGTGCGTTTCCTGATGCTTGTAGGAGGGTC

CACCCTCTGCGTCAGGGAATTCGGCAACATGGCGTCTCCCGCTCCGCCTGCTTGTGACCTCCGAGTC

CTCAGTAAACTGCTTCGTGACTCCCATGTCCTTCACAGCAGACTGAGCCAGTGCCCAGAGGTTCACC

CTTTGCCTACACCTGTCCTGCTGCCTGCTGTGGACTTTAGCTTGGGAGAATGGAAAACCCAGATGGA

GGAGACCAAGGCACAGGACATTCTGGGAGCAGTGACCCTTCTGCTGGAGGGAGTGATGGCAGCACGG

GGACAACTGGGACCCACTTGCCTCTCATCCCTCCTGGGGCAGCTTTCTGGACAGGTCCGTCTCCTCC

TTGGGGCCCTGCAGAGCCTCCTTGGAACCCAGCTTCCTCCACAG pMON28528
GCTAACTGCTCTATAATGATCGATGAAATTATACATCACTTAAAGAGACCACCTGCACCTTTGCTGG    (SEQ ID NO:139)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCTCACAAGGATCCCAATGCCATCTTCCTGA

GCTTCCAACACCTGCTCCGAGGAAAGGTGCGTTTCCTGATGCTTGTAGGAGGGTCCACCCTCTGCGT

CAGGGAATTCGGCAACATGGCGTCTCCCGCTCCGCCTGCTTGTGACCTCCGAGTCCTCAGTAAACTG

CTTCGTGACTCCCATGTCCTTCACAGCAGACTGAGCCAGTGCCCAGAGGTTCACCCTTTGCCTACAC

CTGTCCTGCTGCCTGCTGTGGACTTTAGCTTGGGAGAATGGAAAACCCAGATGGAGGAGACCAAGGC

ACAGGACATTCTGGGAGCAGTGACCCTTCTGCTGGAGGGAGTGATGGCAGCACGGGACAACTGGGA

CCCACTTGCCTCTCATCCCTCCTGGGGCAGCTTTCTGGACAGGTCCGTCTCCTCCTTGGGGCCCTGC

AGAGCCTCCTTGGAACCCAGCTTCCTCCACAGGGCAGGACCACA pMON28529
GCTAACTGCTCTATAATGATCGATGAAATTATACATCACTTAAAGAGACCACCTGCACCTTTGCTGG    (SEQ ID NO:140)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGATCCCAATGCCATCTTCCTGAGCTTCCAAC

ACCTGCTCCGAGGAAAGGTGCGTTTCCTGATGCTTGTAGGAGGGTCCACCCTCTGCGTCAGGGAATT

CGGCAACATGGCGTCTCCCGCTCCGCCTGCTTGTGACCTCCGAGTCCTCAGTAAACTGCTTCGTGAC

TCCCATGTCCTTCACAGCAGACTGAGCCAGTGCCCAGAGGTTCACCCTTTGCCTACACCTGTCCTGC

TGCCTGCTGTGGACTTTAGCTTGGGAGAATGGAAAACCCAGATGGAGGAGACCAAGGCACAGGACAT

TCTGGGAGCAGTGACCCTTCTGCTGGAGGGAGTGATGGCAGCACGGGACAACTGGGACCCACTTGC

CTCTCATCCCTCCTGGGGCAGCTTTCTGGACAGGTCCGTCTCCTCCTTGGGGCCCTGCAGAGCCTCC

TTGGAACCCAGCTTCCTCCACAGGGCAGGACCACAGCTCACAAG pMON28530
GCTAACTGCTCTATAATGATCGATGAAATTATACATCACTTAAAGAGACCACCTGCACCTTTGCTGG    (SEQ ID NO:141)

ACCCGAACAACCTCAATGACGAAGACGTCTCTATCCTGATGGACCGAAACCTTCGACTTCCAAACCT

TABLE 2-continued

GENE SEQUENCES

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCCATCTTCCTGAGCTTCCAACACCTGCTCC

GAGGAAAGGTGCGTTTCCTGATGCTTGTAGGAGGGTCCACCCTCTGCGTCAGGGAATTCGGCAACAT

GGCGTCTCCCGCTCCGCCTGCTTGTGACCTCCGAGTCCTCAGTAAACTGCTTCGTGACTCCCATGTC

CTTCACAGCAGACTGAGCCAGTGCCCAGAGGTTCACCCTTTGCCTACACCTGTCCTGCTGCCTGCTG

TGGACTTTAGCTTGGGAGAATGGAAAACCCAGATGGAGGAGACCAAGGCACAGGACATTCTGGGAGC

AGTGACCCTTCTGCTGGAGGGAGTGATGGCAGCACGGGACAACTGGGACCCACTTGCCTCTCATCC

CTCCTGGGGCAGCTTTCTGGACAGGTCCGTCTCCTCCTTGGGGCCCTGCAGAGCCTCCTTGGAACCC

AGCTTCCTCCACAGGGCAGGACCACAGCTCACAAGGATCCCAAT pMON28533
GCTAACTGCTCTATAATGATCGATGAAATTATACATCACTTAAAGAGACCACCTGCACCTTTGCTGG    (SEQ ID NO:142)

ACCCGAACAACCTCAATGACGAAGACGTCTCTATCCTGATGGACCGAAACCTTGACTTCCAAACCTG

GAGAGCTTCGTAAGGGCTGTCAAGAACTTAGAAAATGCATCAGGTATGAGGCAATTCTTCGTAATCT

CCAACCATGTCTGCCCTCTGCCACGGCCGCACCCTCTCGCATCCAATCATCATCAAGGCAGGTGACT

GGCAAGAATTCCGGGAAAAACTGACGTTCTATTGGTTACCCTTGAGCAAGCGCAGGAACAACAGTAC

GTAGAGGGCGGTGGAGGCTCCCCGGTAACCGTCTGGTCCAATCTCTACTATCAACCCGTCTCCTCCG

TCTAAAGAATCTCATAAATCTCCAAACATGGAGGTTCACCCTTTGCCTACACCTGTCCTGCTGCCTG

CTGTGGACTTTAGCTTGGGAGAATGGAAAACCCAGATGGAGGAGACCAAGGCACAGGACATTCTGGG

AGCAGTGACCCTTCTGCTGGAGGGAGTGATGGCAGCACGGGACAACTGGGACCCACTTGCCTCTCA

TCCCTCCTGGGGCAGCTTTCTGGACAGGTCCGTCTCCTCCTTGGGGCCCTGCAGAGCCTCCTTGGAA

CCCAGCTTCCTCCACAGGGCAGGACCACAGCTCACAAGGATCCCAATGCCATCTTCCTGAGCTTCCA

ACACCTGCTCCGAGGAAAGGTGCGTTTCCTGATGCTTGTAGGAGGGTCCACCCTCTGCGTCAGGGAA

TTCGGCGGCAACGGCGGCAACATGGCGTCCCCAGCGCCGCCTGCTTGTGACCTCCGAGTCCTCAGTA

AACTGCTTCGTGACTCCCATGTCCTTCACAGCAGACTGAGCCAGTGCCCA pMON28534
GCTAACTGCTCTATAATGATCGATGAAATTATACATCACTTAAAGAGACCACCTGCACCTTTGCTGG    (SEQ ID NO:143)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGTTGCCTACACCTGTCCTGCTGCCTGCTGTGG

ACTTTAGCTTGGGAGAATGGAAAACCCAGATGGAGGAGACCAAGGCACAGGACATTCTGGGAGCAGT

GACCCTTCTGCTGGAGGGAGTGATGGCAGCACGGGACAACTGGGACCCACTTGCCTCTCATCCCTC

CTGGGGCAGCTTTCTGGACAGGTCCGTCTCCTCCTTGGGGCCCTGCAGAGCCTCCTTGGAACCCAGC

TTCCTCCACAGGGCAGGACCACAGCTCACAAGGATCCCAATGCCATCTTCCTGAGCTTCCAACACCT

GCTCCGAGGAAAGGTGCGTTTCCTGATGCTTGTAGGAGGGTCCACCCTCTGCGTCAGGGAATTCGGC

TABLE 2-continued

GENE SEQUENCES

GGCAACGGCGGCAACATGGCGTCCCCAGCGCCGCCTGCTTGTGACCTCCGAGTCCTCAGTAAACTGC

TTCGTGACTCCCATGTCCTTCACAGCAGACTGAGCCAGTGCCCAGAGGTTCACCCT pMON28535
GCTAACTGCTCTATAATGATCGATGAAATTATACATCACTTAAAGAGACCACCTGCACCTTTGCTGG  (SEQ ID NO:144)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGTCCTGCTGCCTGCTGTGGACTTTAGCTTGG

GAGAATGGAAAACCCAGATGGAGGAGACCAAGGCACAGGACATTCTGGGAGCAGTGACCCTTCTGCT

GGAGGGAGTGATGGCAGCACGGGACAACTGGGACCCACTTGCCTCTCATCCCTCCTGGGGCAGCTT

TCTGGACAGGTCCGTCTCCTCCTTGGGGCCCTGCAGAGCCTCCTTGGAACCCAGCTTCCTCCACAGG

GCAGGACCACAGCTCACAAGGATCCCAATGCCATCTTCCTGAGCTTCCAACACCTGCTCCGAGGAAA

GGTGCGTTTCCTGATGCTTGTAGGAGGGTCCACCCTCTGCGTCAGGGAATTCGGCGGCAACGGCGGC

AACATGGCGTCCCCAGCGCCGCCTGCTTGTGACCTCCGAGTCCTCAGTAAACTGCTTCGTGACTCCC

ATGTCCTTCACAGCAGACTGAGCCAGTGCCCAGAGGTTCACCCTTTGCCTACACCT pMON28536
GCTAACTGCTCTATAATGATCGATGAAATTATACATCACTTAAAGAGACCACCTGCACCTTTGCTGG  (SEQ ID NO:145)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCTGTGGACTTTAGCTTGGGAGAATGGAAAA

CCCAGATGGAGGAGACCAAGGCACAGGACATTCTGGGAGCAGTGACCCTTCTGCTGGAGGGAGTGAT

GGCAGCACGGGACAACTGGGACCCACTTGCCTCTCATCCCTCCTGGGGCAGCTTTCTGGACAGGTC

CGTCTCCTCCTTGGGGCCCTGCAGAGCCTCCTTGGAACCCAGCTTCCTCCACAGGGCAGGACCACAG

CTCACAAGGATCCCAATGCCATCTTCCTGAGCTTCCAACACCTGCTCCGAGGAAAGGTGCGTTTCCT

GATGCTTGTAGGAGGGTCCACCCTCTGCGTCAGGGAATTCGGCGGCAACGGCGGCAACATGGCGTCC

CCAGCGCCGCCTGCTTGTGACCTCCGAGTCCTCAGTAAACTGCTTCGTGACTCCCATGTCCTTCACA

GCAGACTGAGCCAGTGCCCAGAGGTTCACCCTTTGCCTACACCTGTCCTGCTGCCT pMON28537
GCTAACTGCTCTATAATGATCGATGAAATTATACATCACTTAAAGAGACCACCTGCACCTTTGCTGG  (SEQ ID NO:146)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGACTTTAGCTTGGGAGAATGGAAAACCCAGA

TABLE 2-continued

GENE SEQUENCES

TGGAGGAGACCAAGGCACAGGACATTCTGGGAGCAGTGACCCTTCTGCTGGAGGGAGTGATGGCAGC
ACGGGGACAACTGGGACCCACTTGCCTCTCATCCCTCCTGGGGCAGCTTTCTGGACAGGTCCGTCTC
CTCCTTGGGGCCCTGCAGAGCCTCCTTGGAACCCAGCTTCCTCCACAGGGCAGGACCACAGCTCACA
AGGATCCCAATGCCATCTTCCTGAGCTTCCAACACCTGCTCCGAGGAAAGGTGCGTTTCCTGATGCT
TGTAGGAGGGTCCACCCTCTGCGTCAGGGAATTCGGCGGCAACGGCGGCAACATGGCGTCCCCAGCG
CCGCCTGCTTGTGACCTCCGAGTCCTCAGTAAACTGCTTCGTGACTCCCATGTCCTTCACAGCAGAC
TGAGCCAGTGCCCAGAGGTTCACCCTTTGCCTACACCTGTCCTGCTGCCTGCTGTG pMON28538
GCTAACTGCTCTATAATGATCGATGAAATTATACATCACTTAAAGAGACCACCTGCACCTTTGCTGG     (SEQ ID NO:147)
ACCCGAACAACCTCAATGACGAAGACGTCTCTATCCTGATGGACCGAAACCTTCGACTTCCAAACCT
GGAGAGCTTCGTAAGGGCTGTCAAGAACTTAGAAAATGCATCAGGTATTGAGGCAATTCTTCGTAAT
CTCCAACCATGTCTGCCCTCTGCCACGGCCGCACCCTCTCGACATCCAATCATCATCAAGGCAGGTG
ACTGGCAAGAATTCCGGGAAAAACTGACGTTCTATCTGGTTACCCTTGAGCAAGCGCAGGAACAACA
GTACGTAGAGGGCGGTGGAGGCTCCCCGGGTGAACCGTCTGGTCCAATCTCTACTATCAACCCGTCT
CCTCCGTCTAAAGAATCTCATAAATCTCCAAACATGGGAGAATGGAAAACCCAGATGGAGGAGACCA
AGGCACAGGACATTCTGGGAGCAGTGACCCTTCTGCTGGAGGGAGTGATGGCAGCACGGGGACAACT
GGGACCCACTTGCCTCTCATCCCTCCTGGGGCAGCTTTCTGGACAGGTCCGTCTCCTCCTTGGGGCC
CTGCAGAGCCTCCTTGGAACCCAGCTTCCTCCACAGGGCAGGACCACAGCTCACAAGGATCCCAATG
CCATCTTCCTGAGCTTCCAACACCTGCTCCGAGGAAAGGTGCGTTTCCTGATGCTTGTAGGAGGGTC
CACCCTCTGCGTCAGGGAATTCGGCGGCAACGGCGGCAACATGGCGTCCCCAGCGCCGCCTGCTTGT
GACCTCCGAGTCCTCAGTAAACTGCTTCGTGACTCCCATGTCCTTCACAGCAGACTGAGCCAGTGCC
CAGAGGTTCACCCTTTGCCTACACCTGTCCTGCTGCCTGCTGTGGACTTTAGCTTG pMON28539
GCTAACTGCTCTATAATGATCGATGAAATTATACATCACTTAAAGAGACCACCTGCACCTTTGCTGG     (SEQ ID NO:148)
ACCCGAACAACCTCAATGACGAAGACGTCTCTATCCTGATGGACCGAAACCTTCGACTTCCAAACCT
GGAGAGCTTCGTAAGGGCTGTCAAGAACTTAGAAAATGCATCAGGTATTGAGGCAATTCTTCGTAAT
&TCCAACCATGTCTGCCCTCTGCCACGGCCGCACCCTCTCGACATCCAATCATCATCAAGGCAGGTG
ACTGGCAAGAATTCCGGGAAAAACTGACGTTCTATCTGGTTACCCTTGAGCAAGCGCAGGAACAACA
GTACGTAGAGGGCGGTGGAGGCTCCCCGGGTGAACCGTCTGGTCCAATCTCTACTATCAACCCGTCT
CCTCCGTCTAAAGAATCTCATAAATCTCCAAACATGGGACCCACTTGCCTCTCATCCCTCCTGGGGC
AGCTTTCTGGACAGGTCCGTCTCCTCCTTGGGGCCCTGCAGAGCCTCCTTGGAACCCAGCTTCCTCC
ACAGGGCAGGACCACAGCTCACAAGGATCCCAATGCCATCTTCCTGAGCTTCCAACACCTGCTCCGA
GGAAAGGTGCGTTTCCTGATGCTTGTAGGAGGGTCCACCCTCTGCGTCAGGGAATTCGGCGGCAACG
GCGGCAACATGGCGTCCCCAGCGCCGCCTGCTTGTGACCTCCGAGTCCTCAGTAAACTGCTTCGTGA
CTCCCATGTCCTTCACAGCAGACTGAGCCAGTGCCCAGAGGTTCACCCTTTGCCTACACCTGTCCTG
CTGCCTGCTGTGGACTTTAGCTTGGGAGAATGGAAAACCCAGATGGAGGAGACCAAGGCACAGGACA
TTCTGGGAGCAGTGACCCTTCTGCTGGAGGGAGTGATGGCAGCACGGGGACAACTG pMON28540
GCTAACTGCTCTATAATGATCGATGAAATTATACATCACTTAAAGAGACCACCTGCACCTTTGCTGG     (SEQ ID NO:149)
ACCCGAACAACCTCAATGACGAAGACGTCTCTATCCTGATGGACCGAAACCTTCGACTTCCAAACCT

TABLE 2-continued

GENE SEQUENCES

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGAACCCAGCTTCCTCCACAGGGCAGGACCA

CAGCTCACAAGGATCCCAATGCCATCTTCCTGAGCTTCCAACACCTGCTCCGAGGAAAGGTGCGTTT

CCTGATGCTTGTAGGAGGGTCCACCCTCTGCGTCAGGGAATTCGGCGGCAACGGCGGCAACATGGCG

TCCCCAGCGCCGCCTGCTTGTGACCTCCGAGTCCTCAGTAAACTGCTTCGTGACTCCCATGTCCTTC

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAQCTTTCTGGACAGGTCCGTCTCCTCCTTGGGGCCCTGCAGAGCCTCCTT pMON28541
GCTAACTGCTCTATAATGATCGATGAAATTATACATCACTTAAAGAGACCACCTGCACCTTTGCTGG (SEQ ID NO:150)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGGCAGGACCACAGCTCACAAGGATCCCAATG

CCATCTTCCTGAGCTTCCAACACCTGCTCCGAGGAAAGGTGCGTTTCCTGATGCTTGTAGGAGGGTC

CACCCTCTGCGTCAGGGAATTCGGCGGCAACGGCGGCAACATGGCGTCCCCAGCGCCGCCTGCTTGT

GACCTCCGAGTCCTCAGTAAACTGCTTCGTGACTCCCATGTCCTTCACAGCAGACTGAGCCAGTGCC

CAGAGGTTCACCCTTTGCCTACACCTGTCCTGCTGCCTGCTGTGGACTTTAGCTTGGGAGAATGGAA

AACCCAGATGGAGGAGACCAAGGCACAGGACATTCTGGGAGCAGTGACCCTTCTGCTGGAGGGAGTG

ATGGCAGCACGGGACAACTGGGACCCACTTGCCTCTCATCCCTCCTGGGGCAGCTTTCTGGACAGG

TCCGTCTCCTCCTTGGGGCCCTGCAGAGCCTCCTTGGAACCCAGCTTCCTCCACAG pMON28542
GCTAACTGCTCTATAATGATCGATGAAATTATACATCACTTAAAGAGACCACCTGCACCTTTGCTGG (SEQ ID NO:151)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCTCACAAGGATCCCAATGCCATCTTCCTGA

GCTTCCAACACCTGCTCCGAGGAAAGGTGCGTTTCCTGATGCTTGTAGGAGGGTCCACCCTCTGCGT

CAGGGAATTCGGCGGCAACGGCGGCAACATGGCGTCCCCAGCGCCGCCTGCTTGTGACCTCCGAGTC

CTCAGTAAACTGCTTCGTGACTCCCATGTCCTTCACAGCAGACTGAGCCAGTGCCCAGAGGTTCACC

CTTTGCCTACACCTGTCCTGCTGCCTGCTGTGGACTTTAGCTTGGGAGAATGGAAAACCCAGATGGA

TABLE 2-continued

GENE SEQUENCES

GGAGACCAAGGCACAGGACATTCTGGGAGCAGTGACCCTTCTGCTGGAGGGAGTGATGGCAGCACGG

GGACAACTGGGACCCACTTGCCTCTCATCCCTCCTGGGGCAGCTTTCTGGACAGGTCCGTCTCCTCC

TTGGGGCCCTGCAGAGCCTCCTTGGAACCCAGCTTCCTCCACAGGGCAGGACCACA pMON28543
GCTAACTGCTCTATAATGATCGATGAAATTATACATCACTTAAAGAGACCACCTGCACCTTTGCTGG  (SEQ ID NO:152)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGATCCCAATGCCATCTTCCTGAGCTTCCAAC

ACCTGCTCCGAGGAAAGGTGCGTTTCCTGATGCTTGTAGGAGGGTCCACCCTCTGCGTCAGGGAATT

CGGCGGCAACGGCGGCAACATGGCGTCCCCAGCGCCGCCTGCTTGTGACCTCCGAGTCCTCAGTAAA

CTGCTTCGTGACTCCCATGTCCTTCACAGCAGACTGAGCCAGTGCCCAGAGGTTCACCCTTTGCCTA

CACCTGTCCTGCTGCCTGCTGTGGACTTTAGCTTGGGAGAATGGAAAACCCAGATGGAGGAGACCAA

GGCACAGGACATTCTGGGAGCAGTGACCCTTCTGCTGGAGGGAGTGATGGCAGCACGGGACAACTG

GGACCCACTTGCCTCTCATCCCTCCTGGGGCAGCTTTCTGGACAGGTCCGTCTCCTCCTTGGGGCCC

TGCAGAGCCTCCTTGGAACCCAGCTTCCTCCACAGGGCAGGACCACAGCTCACAAG pMON28544
GCTAACTGCTCTATAATGATCGATGAAATTATACATCACTTAAAGAGACCACCTGCACCTTTGCTGG  (SEQ ID NO:153)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

CCTCCGTCTAAAGAATCTCATAAATCTCCAAACATGGCCATCTTCCTGAGCTTCCAACACCTGCTCC

GAGGAAAGGTGCGTTTCCTGATGCTTGTAGGAGGGTCCACCCTCTGCGTCAGGGAATTCGGCGGCAA

CGGCGGCAACATGGCGTCCCCAGCGCCGCCTGCTTGTGACCTCCGAGTCCTCAGTAAACTGCTTCGT

GACTCCCATGTCCTTCACAGCAGACTGAGCCAGTGCCCAGAGGTTCACCCTTTGCCTACACCTGTCC

TGCTGCCTGCTGTGGACTTTAGCTTGGGAGAATGGAAAACCCAGATGGAGGAGACCAAGGCACAGGA

CATTCTGGGAGCAGTGACCCTTCTGCTGGAGGGAGTGATGGCAGCACGGGACAACTGGGACCCACT

TGCCTCTCATCCCTCCTGGGGCAGCTTTCTGGACAGGTCCGTCTCCTCCTTGGGGCCCTGCAGAGCC

TCCTTGGAACCCAGCTTCCTCCACAGGGCAGGACCACAGCTCACAAGGATCCCAAT pMON28545
GCTAACTGCTCTATAATGATCGATGAAATTATACATCACTTAAAGAGACCACCTGCACCTTTGCTGG  (SEQ ID NO:154)

ACCCGAACAACCTCAATGACGAAGACGTCTCTATCCTGATGGACCGAAACCTTCGACTTCCAAACCT

GGAGAGCTTCGTAAGGGCTGTCAAGAACTTAGAAAATGCATCAGGTATTGAGGCAATTCTTCGTAAT

CTCCAACCATGTCTGCCCTCTGCCACGGCCGCACCCTCTCGACATCCAATCATCATCAAGGCAGGTG

ACTGGCAAGAATTCCGGGAAAAACTGACGTTCTATCTGGTTACCCTTGAGCAAGCGCAGGAACAACA

GTACGTAGAGGGCGGTGGAGGCTCCCCGGGTGAACCGTCTGGTCCAATCTCTACTATCAACCCGTCT

TABLE 2-continued

GENE SEQUENCES

CCTCCGTCTAAAGAATCTCATAAATCTCCAAACATGGATCCCAATGCCATCTTCCTGAGCTTCCAAC

ACCTGCTCCGAGGAAAGGTGCGTTTCCTGATGCTTGTAGGAGGGTCCACCCTCTGCGTCAGGGAATT

CGGCGGCAACATGGCGTCTCCCGCTCCGCCTGCTTGTGACCTCCGAGTCCTCAGTAAACTGCTTCGT

GACTCCCATGTCCTTCACAGCAGACTGAGCCAGTGCCCAGAGGTTCACCCTTTGCCTACACCTGTCC

TGCTGCCTGCTGTGGACTTTAGCTTGGGAGAATGGAAAACCCAGATGGAGGAGACCAAGGCACAGGA

CATTCTGGGAGCAGTGACCCTTCTGCTGGAGGGAGTGATGGCAGCACGGGGACAACTGGGACCCACT

TGCCTCTCATCCCTCCTGGGGCAGCTTTCTGGACAGGTCCGTCTCCTCCTTGGGGCCCTGCAGAGCC

TCCTTGGAACCCAGGGCAGGACCACAGCTCACAAG pMON15981
```
  1  ATGGCTAACT GCTCTATAAT GATCGATGAA ATTATACATC ACTTAAAGAG        (SEQ ID NO:155)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GTCTTACAAG
451  CTGTGCCACC CCGAGGAGCT GGTGCTGCTC GGACACTCTC TGGGCATCCC
501  CTGGGCTCCC CTGAGCTCCT GCCCCAGCCA GGCCCTGCAG CTGGCAGGCT
551  GCTTGAGCCA ACTCCATAGC GGCCTTTTCC TCTACCAGGG GCTCCTGCAG
601  GCCCTGGAAG GGATATCCCC CGAGTTGGGT CCCACCTTGG ACACACTGCA
651  GCTGGACGTC GCCGACTTTG CCACCACCAT CTGGCAGCAG ATGGAAGAAC
701  TGGGAATGGC CCCTGCCCTG CAGCCCACCC AGGGTGCCAT GCCGGCCTTC
751  GCCTCTGCTT TCCAGCGCCG GGCAGGAGGG GTCCTGGTTG CTAGCCATCT
801  GCAGAGCTTC CTGGAGGTGT CGTACCGCGT TCTACGCCAC CTTGCGCAGC
851  CCGGCGGCGG CTCTGACATG GCTACACCAT TAGGCCCTGC CAGCTCCCTG
901  CCCCAGAGCT TCCTGCTCAA GTCTTTAGAG CAAGTGAGGA AGATCCAGGG
951  CGATGGCGCA GCGCTCCAGG AGAAGCTGTG TGCCACCTAA TAA;
``` pMON15982
```
  1  ATGGCTAACT GCTCTATAAT GATCGATGAA ATTATACATC ACTTAAAGAG        (SEQ ID NO:156)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GTCTCCCGAG
451  TTGGGTCCCA CCTTGGACAC ACTGCAGCTG GACGTCGCCG ACTTTGCCAC
```

TABLE 2-continued

GENE SEQUENCES

```
501  CACCATCTGG CAGCAGATGG AAGAACTGGG AATGGCCCCT GCCCTGCAGC
551  CCACCCAGGG TGCCATGCCG GCCTTCGCCT CTGCTTTCCA GCGCCGGGCA
601  GGAGGGGTCC TGGTTGCTAG CCATCTGCAG AGCTTCCTGG AGGTGTCGTA
651  CCGCGTTCTA CGCCACCTTG CGCAGCCCGG CGGCGGCTCT GACATGGCTA
701  CACCATTAGG CCCTGCCAGC TCCCTGCCCC AGAGCTTCCT GCTCAAGTCT
751  TTAGAGCAAG TGAGGAAGAT CCAGGGCGAT GGCGCAGCGC TCCAGGAGAA
801  GCTGTGTGCC ACCTACAAGC TGTGCCACCC CGAGGAGCTG GTGCTGCTCG
851  GACACTCTCT GGGCATCCCC TGGGCTCCCC TGAGCTCCTG CCCCAGCCAG
901  GCCCTGCAGC TGGCAGGCTG CTTGAGCCAA CTCCATAGCG GCCTTTTCCT
951  CTACCAGGGG CTCCTGCAGG CCCTGGAAGG GATATCCTAA TAA;
``` pMON15965
```
  1  ATGGCTAACT GCTCTATAAT GATCGATGAA ATTATACATC ACTTAAAGAG    (SEQ ID NO:157)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GTCTTCTGCT
451  TTCCAGCGCC GGGCAGGAGG GGTCCTGGTT GCTAGCCATC TGCAGAGCTT
501  CCTGGAGGTG TCGTACCGCG TTCTACGCCA CCTTGCGCAG CCCGGCGGCG
551  GCTCTGACAT GGCTACACCA TTAGGCCCTG CCAGCTCCCT GCCCCAGAGC
601  TTCCTGCTCA AGTCTTTAGA GCAAGTGAGG AAGATCCAGG GCGATGGCGC
651  AGCGCTCCAG GAGAAGCTGT GTGCCACCTA CAAGCTGTGC CACCCCGAGG
701  AGCTGGTGCT GCTCGGACAC TCTCTGGGCA TCCCCTGGGC TCCCCTGAGC
751  TCCTGCCCCA GCCAGGCCCT GCAGCTGGCA GGCTGCTTGA GCCAACTCCA
801  TAGCGGCCTT TTCCTCTACC AGGGGCTCCT GCAGGCCCTG GAAGGGATAT
851  CCCCCGAGTT GGGTCCCACC TTGGACACAC TGCAGCTGGA CGTCGCCGAC
901  TTTGCCACCA CCATCTGGCA GCAGATGGAA GAACTGGGAA TGGCCCCTGC
951  CCTGCAGCCC ACCCAGGGTG CCATGCCGGC CTTCGCCTAA TAA
``` pMON15966
```
  1  ATGGCTAACT GCTCTATAAT GATCGATGAA ATTATACATC ACTTAAAGAG    (SEQ ID NO:158)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
```

TABLE 2-continued

GENE SEQUENCES

```
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GTCTATGGCC
451  CCTGCCCTGC AGCCCACCCA GGGTGCCATG CCGGCCTTCG CCTCTGCTTT
501  CCAGCGCCGG GCAGGAGGGG TCCTGGTTGC TAGCCATCTG CAGAGCTTCC
551  TGGAGGTGTC GTACCGCGTT CTACGCCACC TTGCGCAGCC CGGCGGCGGC
601  TCTGACATGG CTACACCATT AGGCCCTGCC AGCTCCCTGC CCCAGAGCTT
651  CCTGCTCAAG TCTTTAGAGC AAGTGAGGAA GATCCAGGGC GATGGCGCAG
701  CGCTCCAGGA GAAGCTGTGT GCCACCTACA AGCTGTGCCA CCCCGAGGAG
751  CTGGTGCTGC TCGGACACTC TCTGGGCATC CCCTGGGCTC CCTGAGCTC
801  CTGCCCCAGC CAGGCCCTGC AGCTGGCAGG CTGCTTGAGC CAACTCCATA
851  GCGGCCTTTT CCTCTACCAG GGGCTCCTGC AGGCCCTGGA AGGGATATCC
901  CCCGAGTTGG GTCCCACCTT GGACACACTG CAGCTGGACG TCGCCGACTT
951  TGCCACCACC ATCTGGCAGC AGATGGAAGA ACTGGGATAA TAA
``` pMON15967
```
  1  ATGGCTAACT GCTCTATAAT GATCGATGAA ATTATACATC ACTTAAAGAG   (SEQ ID NO:159)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GTCTACCCAG
451  GGTGCCATGC CGGCCTTCGC CTCTGCTTTC AGCGCCGGG CAGGAGGGGT
501  CCTGGTTGCT AGCCATCTGC AGAGCTTCCT GGAGGTGTCG TACCGCGTTC
551  TACGCCACCT TGCGCAGCCC GGCGGCGGCT CTGACATGGC TACACCATTA
601  GGCCCTGCCA GCTCCCTGCC CCAGAGCTTC CTGCTCAAGT CTTTAGAGCA
651  AGTGAGGAAG ATCCAGGGCG ATGGCGCAGC GCTCCAGGAG AAGCTGTGTG
701  CCACCTACAA GCTGTGCCAC CCCGAGGAGC TGGTGCTGCT CGGACACTCT
751  CTGGGCATCC CCTGGGCTCC CCTGAGCTCC TGCCCCAGCC AGGCCCTGCA
801  GCTGGCAGGC TGCTTGAGCC AACTCCATAG CGGCCTTTTC CTCTACCAGG
851  GGCTCCTGCA GGCCCTGGAA GGGATATCCC CCGAGTTGGG TCCCACCTTG
901  GACACACTGC AGCTGGACGT CGCCGACTTT GCCACCACCA TCTGGCAGCA
951  GATGGAAGAA CTGGGAATGG CCCCTGCCCT GCAGCCCTAA TAA
``` pMON15960
```
  1  ATGGCTACAC CATTGGGCCC TGCCAGCTCC CTGCCCCAGA GCTTCCTGCT   (SEQ ID NO:160)
 51  CAAGTCTTTA GAGCAAGTGA GGAAGATCCA GGGCGATGGC AGCGCTCC
101  AGGAGAAGCT GTGTGCCACC TACAAGCTGT GCCACCCCGA GGAGCTGGTG
151  CTGCTCGGAC ACTCTCTGGG CATCCCCTGG GCTCCCCTGA GCTCCTGCCC
201  CAGCCAGGCC CTGCAGCTGG CAGGCTGCTT GAGCCAACTC CATAGCGGCC
```

TABLE 2-continued

GENE SEQUENCES

```
 251 TTTTCCTCTA CCAGGGGCTC CTGCAGGCCC TGGAAGGGAT ATCCCCCGAG
 301 TTGGGTCCCA CCTTGGACAC ACTGCAGCTG GACGTCGCCG ACTTTGCCAC
 351 CACCATCTGG CAGCAGATGG AAGAACTGGG AATGGCCCCT GCCCTGCAGC
 401 CCACCCAGGG TGCCATGCCG GCCTTCGCCT CTGCTTTCCA GCGCCGGGCA
 451 GGAGGGGTCC TGGTTGCTAG CCATCTGCAG AGCTTCCTGG AGGTGTCGTA
 501 CCGCGTTCTA CGCCACCTTG CGCAGCCCGG CGGCGGCTCT GACATGGCTA
 551 CACCATTGGG CCCTGCCAGC TCCCTGCCCC AGAGCTTCCT GCTCAAGTCT
 601 TTAGAGCAAG TGAGGAAGAT CCAGGGCGAT GGCGCAGCGC TCCAGGAGAA
 651 GCTGTGTGCC ACCTACAAGC TGTGCCACCC CGAGGAGCTG GTGCTGCTCG
 701 GACACTCTCT GGGCATCCCC TGGGCTCCCC TGAGCTCCTG CCCCAGCCAG
 751 GCCCTGCAGC TGGCAGGCTG CTTGAGCCAA CTCCATAGCG GCCTTTTCCT
 801 CTACCAGGGG CTCCTGCAGG CCCTGGAAGG GATATCCCCC GAGTTGGGTC
 851 CCACCTTGGA CACACTGCAG CTGGACGTCG CCGACTTTGC CACCACCATC
 901 TGGCAGCAGA TGGAAGAACT GGGAATGGCC CCTGCCCTGC AGCCCACCCA
1001 TCCTGGTTGC TAGCCATCTG CAGAGCTTCC TGGAGGTGTC GTACCGCGTT
1051 CTACGCCACC TTGCGCAGCC CTGATAA
```

PMON32132
TCTCCCGCTCCGCCTGCTTGTGACCTCCGAGTCCTCAGTAAACTGCTTCGTGACTCCCATGTCCTTC    (SEQ ID NO:249)

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGCT

TCCTCCACAGGGCAGGACCACAGCTCACAAGGATCCCAATGCCATCTTCCTGAGCTTCCAACACCTG

CTCCGAGGAAAGGTGCGTTTCCTGATGCTTGTAGGAGGGTCCACCCTCTGCGTCAGG

PMON32133
TCTCCCGCTCCGCCTGCTTGTGACCTCCGAGTCCTCAGTAAACTGCTTCGTGACTCCCATGTCCTTC    (SEQ ID NO :250)

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGGG

CAGGACCACAGCTCACAAGGATCCCAATGCCATCTTCCTGAGCTTCCAACACCTGCTCCGAGGAAAG

GTGCGTTTCCTGATGCTTGTAGGAGGGTCCACCCTCTGCGTCAGG pMON32134
TCCCCAGCGCCGCCTGCTTGTGACCTCCGAGTCCTCAGTAAACTGCTTCGTGACTCCCATGTCCTTC    (SEQ ID NO:251)

ACAGCAGACTGAGCCAGTGCCCAGAGGTTCACCCTTTGCCTACACCTGTCCTGCTGCCTGCTGTGGA

CTTTAGCTTGGGAGAATGGAAAACCCAGATGGAGGAGACCAAGGCACAGGACATTCTGGGAGCAGTG

ACCCTTCTGCTGGAGGGAGTGATGGCAGCACGGGACAACTGGGACCCACTTGCCTCTCATCCCTCC

TGGGGCAGCTTTCTGGACAGGTCCGTCTCCTCCTTGGGGCCCTGCAGAGCCTCCTTGGAACCCAGCT

TCCTCCACAGGGCAGGACCACAGCTCACAAGGATCCCAATGCCATCTTCCTGAGCTTCCAACACCTG

CTCCGAGGAAAGGTGCGTTTCCTGATGCTTGTAGGAGGGTCCACCCTCTGCGTCAGG

TABLE 2-continued

GENE SEQUENCES pMON13181
```
  1  CCATGGCTAA CTGCTCTATA ATGATCGATG AAATTATACA TCACTTAAAG     (SEQ ID NO:257)
 51  AGACCACCTG CACCTTTGCT GGACCCGAAC AACCTCAATG ACGAAGACGT
101  CTCTATCCTG ATGGATCGAA ACCTTCGACT TCCAAACCTG GAGAGCTTCG
151  TAAGGGCTGT CAAGAACTTA GAAAATGCAT CAGGTATTGA GGCAATTCTT
201  CGTAATCTCC AACCATGTCT GCCCTCTGCC ACGGCCGCAC CCTCTCGACA
251  TCCAATCATC ATCAAGGCAG GTGACTGGCA AGAATTCCGG GAAAAACTGA
301  CGTTCTATCT GGTTACCCTT GAGCAAGCGC AGGAACAACA GTACGTAgag
351  ggcggtggag gctCCCCGGG TGAACCGTCT GGTCCAATCT CTACTATCAA
401  CCCGTCTCCT CCGTCTAAAG AATCTCATAA ATCTCCAAAC ATGTAAGGTA
451  CCGCATGCAA GCTT
```

Pmon13180.Seq
```
  1  CCATGGCTAA CTGCTCTATA ATGATCGATG AAATTATACA TCACTTAAAG     (SEQ ID NO:258)
 51  AGACCACCTG CACCTTTGCT GGACCCGAAC AACCTCAATG ACGAAGACGT
101  CTCTATCCTG ATGGATCGAA ACCTTCGACT TCCAAACCTG GAGAGCTTCG
151  TAAGGGCTGT CAAGAACTTA GAAAATGCAT CAGGTATTGA GGCAATTCTT
201  CGTAATCTCC AACCATGTCT GCCCTCTGCC ACGGCCGCAC CCTCTCGACA
251  TCCAATCATC ATCAAGGCAG GTGACTGGCA AGAATTCCGG GAAAAACTGA
301  CGTTCTATCT GGTTACCCTT GAGCAAGCGC AGGAACAACA GTACGTAgag
351  ggcggtggag gctcCCCGGG TGGTGGTTCT GGCGGCGGCT CCAACATGTA
401  AGGTACCGCA TGCAAGCTT
``` pmon16017.seq
```
  1  ATGGCTAACT GCTCTATAAT GATCGATGAA ATTATACATC ACTTAAAGAG     (SEQ ID NO:259)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTTTAGGC
451  CCTGCCAGCT CCCTGCCCCA GAGCTTCCTG CTCAAGTCTT TAGAGCAAGT
501  GAGGAAGATC AGGGCGATG GCGCAGCGCT CCAGGAGAAG CTGTGTGCCA
551  CCTACAAGCT GTGCCACCCC GAGGAGCTGG TGCTGCTCGG ACACTCTCTG
601  GGCATCCCCT GGGCTCCCCT GAGCTCCTGC CCCAGCCAGG CCCTGCAGCT
651  GGCAGGCTGC TTGAGCCAAC TCCATAGCGG CCTTTTCCTC TACCAGGGGC
701  TCCTGCAGGC CCTGGAAGGG ATATCCCCCG AGTTGGGTCC CACCTTGGAC
751  ACACTGCAGC TGGACGTCGC CGACTTTGCC ACCACCATCT GGCAGCAGAT
801  GGAAGAACTG GGAATGGCCC CTGCCCTGCA GCCCACCCAG GGTGCCATGC
851  CGGCCTTCGC CTCTGCTTTC CAGCGCCGGG CAGGAGGGGT CCTGGTTGCT
```

TABLE 2-continued

GENE SEQUENCES

901 AGCCATCTGC AGAGCTTCCT GGAGGTGTCG TACCGCGTTC TACGCCACCT

951 TGCGCAGCCC GACATGGCTA CACCA pmon16018.seq
  1 ATGGCTAACT GCTCTATAAT GATCGATGAA ATTATACATC ACTTAAAGAG                    (SEQ ID NO:260)

51 ACCACCTGCA CCTTTGCTGG ACCCGAACAA CCTCAATGAC GAAGACGTCT

101 CTATCCTGAT GGATCGAAAC CTTCGACTTC CAAACCTGGA GAGCTTCGTA

151 AGGGCTGTCA AGAACTTAGA AAATGCATCA GGTATTGAGG CAATTCTTCG

201 TAATCTCCAA CCATGTCTGC CCTCTGCCAC GGCCGCACCC TCTCGACATC

251 CAATCATCAT CAAGGCAGGT GACTGGCAAG AATTCCGGGA AAAACTGACG

301 TTCTATCTGG TTACCCTTGA GCAAGCGCAG GAACAACAGT ACGTAGAGGG

351 CGGTGGAGGC TCCCCGGGTG AACCGTCTGG TCCAATCTCT ACTATCAACC

401 CGTCTCCTCC GTCTAAAGAA TCTCATAAAT CTCCAAACAT GGCTCAGAGC

451 TTCCTGCTCA AGTCTTTAGA GCAAGTGAGG AAGATCCAGG GCGATGGCGC

501 AGCGCTCCAG GAGAAGCTGT GTGCCACCTA CAAGCTGTGC CACCCCGAGG

551 AGCTGGTGCT GCTCGGACAC TCTCTGGGCA TCCCCTGGGC TCCCCTGAGC

601 TCCTGCCCCA GCCAGGCCCT GCAGCTGGCA GGCTGCTTGA GCCAACTCCA

651 TAGCGGCCTT TTCCTCTACC AGGGGCTCCT GCAGGCCCTG GAAGGGATAT

701 CCCCCGAGTT GGGTCCCACC TTGGACACAC TGCAGCTGGA CGTCGCCGAC

751 TTTGCCACCA CCATCTGGCA GCAGATGGAA GAACTGGGAA TGGCCCCTGC

801 CCTGCAGCCC ACCCAGGGTG CCATGCCGGC CTTCGCCTCT GCTTTCCAGC

851 GCCGGGCAGG AGGGGTCCTG GTTGCTAGCC ATCTGCAGAG CTTCCTGGAG

901 GTGTCGTACC GCGTTCTACG CCACCTTGCG CAGCCCGACA TGGCTACACC

951 ATTAGGCCCT GCCAGCTCCC TGCCC pmon16019.seq
  1 ATGGCTAACT GCTCTATAAT GATCGATGAA ATTATACATC ACTTAAAGAG                    (SEQ ID NO:261)

51 ACCACCTGCA CCTTTGCTGG ACCCGAACAA CCTCAATGAC GAAGACGTCT

101 CTATCCTGAT GGATCGAAAC CTTCGACTTC CAAACCTGGA GAGCTTCGTA

151 AGGGCTGTCA AGAACTTAGA AAATGCATCA GGTATTGAGG CAATTCTTCG

201 TAATCTCCAA CCATGTCTGC CCTCTGCCAC GGCCGCACCC TCTCGACATC

251 CAATCATCAT CAAGGCAGGT GACTGGCAAG AATTCCGGGA AAAACTGACG

301 TTCTATCTGG TTACCCTTGA GCAAGCGCAG GAACAACAGT ACGTAGAGGG

351 CGGTGGAGGC TCCCCGGGTG AACCGTCTGG TCCAATCTCT ACTATCAACC

401 CGTCTCCTCC GTCTAAAGAA TCTCATAAAT CTCCAAACAT GGCTTTCCTG

451 CTCAAGTCTT TAGAGCAAGT GAGGAAGATC CAGGGCGATG GCGCAGCGCT

501 CCAGGAGAAG CTGTGTGCCA CCTACAAGCT GTGCCACCCC GAGGAGCTGG

551 TGCTGCTCGG ACACTCTCTG GCATCCCCT GGGCTCCCCT GAGCTCCTGC

601 CCCAGCCAGG CCCTGCAGCT GGCAGGCTGC TTGAGCCAAC TCCATAGCGG

651 CCTTTTCCTC TACCAGGGGC TCCTGCAGGC CCTGGAAGGG ATATCCCCCG

701 AGTTGGGTCC CACCTTGGAC ACACTGCAGC TGGACGTCGC CGACTTTGCC

TABLE 2-continued

GENE SEQUENCES

```
751  ACCACCATCT GGCAGCAGAT GGAAGAACTG GGAATGGCCC CTGCCCTGCA

801  GCCCACCCAG GGTGCCATGC CGGCCTTCGC CTCTGCTTTC CAGCGCCGGG

851  CAGGAGGGGT CCTGGTTGCT AGCCATCTGC AGAGCTTCCT GGAGGTGTCG

901  TACCGCGTTC TACGCCACCT TGCGCAGCCC GACATGGCTA CACCATTAGG

951  CCCTGCCAGC TCCCTGCCCC AGAGC
``` pmon16020.seq
```
  1  ATGGCTAACT GCTCTATAAT GATCGATGAA ATTATACATC ACTTAAAGAG     (SEQ ID NO:262)

51  ACCACCTGCA CCTTTGCTGG ACCCGAACAA CCTCAATGAC GAAGACGTCT

101  CTATCCTGAT GGATCGAAAC CTTCGACTTC CAAACCTGGA GAGCTTCGTA

151  AGGGCTGTCA AGAACTTAGA AAATGCATCA GGTATTGAGG CAATTCTTCG

201  TAATCTCCAA CCATGTCTGC CCTCTGCCAC GGCCGCACCC TCTCGACATC

251  CAATCATCAT CAAGGCAGGT GACTGGCAAG AATTCCGGGA AAAACTGACG

301  TTCTATCTGG TTACCCTTGA GCAAGCGCAG GAACAACAGT ACGTAGAGGG

351  CGGTGGAGGC TCCCCGGGTG AACCGTCTGG TCCAATCTCT ACTATCAACC

401  CGTCTCCTCC GTCTAAAGAA TCTCATAAAT CTCCAAACAT GGCTGAGCAA

451  GTGAGGAAGA TCCAGGGCGA TGGCGCAGCG CTCCAGGAGA AGCTGTGTGC

501  CACCTACAAG CTGTGCCACC CCGAGGAGCT GGTGCTGCTC GGACACTCTC

551  TGGGCATCCC CTGGGCTCCC CTGAGCTCCT GCCCCAGCCA GGCCCTGCAG

601  CTGGCAGGCT GCTTGAGCCA ACTCCATAGC GGCCTTTTCC TCTACCAGGG

651  GCTCCTGCAG GCCCTGGAAG GGATATCCCC CGAGTTGGGT CCCACCTTGG

701  ACACACTGCA GCTGGACGTC GCCGACTTTG CCACCACCAT CTGGCAGCAG

751  ATGGAAGAAC TGGGAATGGC CCCTGCCCTG CAGCCCACCC AGGGTGCCAT

801  GCCGGCCTTC GCCTCTGCTT TCCAGCGCCG GGCAGGAGGG GTCCTGGTTG

851  CTAGCCATCT GCAGAGCTTC TGGAGGTGT CGTACCGCGT TCTACGCCAC

901  CTTGCGCAGC CCGACATGGC TACACCATTA GGCCCTGCCA GCTCCCTGCC

951  CCAGAGCTTC CTGCTCAAGT CTTTA
``` pmon16021.seq
```
  1  ATGGCTAACT GCTCTATAAT GATCGATGAA ATTATACATC ACTTAAAGAG     (SEQ ID NO:263)

51  ACCACCTGCA CCTTTGCTGG ACCCGAACAA CCTCAATGAC GAAGACGTCT

101  CTATCCTGAT GGATCGAAAC CTTCGACTTC CAAACCTGGA GAGCTTCGTA

151  AGGGCTGTCA AGAACTTAGA AAATGCATCA GGTATTGAGG CAATTCTTCG

201  TAATCTCCAA CCATGTCTGC CCTCTGCCAC GGCCGCACCC TCTCGACATC

251  CAATCATCAT CAAGGCAGGT GACTGGCAAG AATTCCGGGA AAAACTGACG

301  TTCTATCTGG TTACCCTTGA GCAAGCGCAG GAACAACAGT ACGTAGAGGG

351  CGGTGGAGGC TCCCCGGGTG AACCGTCTGG TCCAATCTCT ACTATCAACC

401  CGTCTCCTCC GTCTAAAGAA TCTCATAAAT CTCCAAACAT GGCTCTGCTC

451  GGACACTCTC TGGGCATCCC CTGGGCTCCC CTGAGCTCCT GCCCCAGCCA

501  GGCCCTGCAG CTGGCAGGCT GCTTGAGCCA ACTCCATAGC GGCCTTTTCC

551  TCTACCAGGG GCTCCTGCAG GCCCTGGAAG GGATATCCCC CGAGTTGGGT

601  CCCACCTTGG ACACACTGCA GCTGGACGTC GCCGACTTTG CCACCACCAT
```

TABLE 2-continued

GENE SEQUENCES

```
651  CTGGCAGCAG ATGGAAGAAC TGGGAATGGC CCCTGCCCTG CAGCCCACCC
701  AGGGTGCCAT GCCGGCCTTC GCCTCTGCTT TCCAGCGCCC GGCAGGAGGG
751  GTCCTGGTTG CTAGCCATCT GCAGAGCTTC CTGGAGGTGT CGTACCGCGT
801  TCTACGCCAC CTTGCGCAGC CCGACATGGC TACACCATTA GGCCCTGCCA
851  GCTCCCTGCC CCAGAGCTTC CTGCTCAAGT CTTTAGAGCA AGTGAGGAAG
901  ATCCAGGGCG ATGGCGCAGC GCTCCAGGAG AAGCTGTGTG CCACCTACAA
951  GCTGTGCCAC CCCGAGGAGC TGGTG
``` pmon16022.seq

```
  1  ATGGCTAACT GCTCTATAAT GATCGATGAA ATTATACATC ACTTAAAGAG     (SEQ ID NO:264)
 51  ACCACCTGCA CCTTTGCTGG ACCCGAACAA CCTCAATGAC GAAGACGTCT
101  CTATCCTGAT CGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTCCCCTG
451  AGCTCCTGCC CCAGCCAGGC CCTGCAGCTG GCAGGCTGCT TGAGCCAACT
501  CCATAGCGGC CTTTTCCTCT ACCAGGGGCT CCTGCAGGCC CTGGAAGGGA
551  TATCCCCCGA GTTGGGTCCC ACCTTGGACA CACTGCAGCT GGACGTCGCC
601  GACTTTGCCA CCACCATCTG GCAGCAGATG GAAGAACTGG GAATGGCCCC
651  TGCCCTGCAG CCCACCCAGG GTGCCATGCC GGCCTTCGCC TCTGCTTTCC
701  AGCGCCGGGC AGGAGGGGTC CTGGTTGCTA GCCATCTGCA GAGCTTCCTG
751  GAGGTGTCGT ACCGCGTTCT ACGCCACCTT GCGCAGCCCG ACATGGCTAC
801  ACCATTAGGC CCTGCCAGCT CCCTGCCCCA GAGCTTCCTG CTCAAGTCTT
851  TAGAGCAAGT GAGGAAGATC CAGGGCGATG GCGCAGCGCT CCAGGAGAAG
901  CTGTGTGCCA CCTACAAGCT GTGCCACCCC GAGGAGCTGG TGCTGCTCGG
951  ACACTCTCTG GCATCCCCT GGGCT
``` pmon16023.seq

```
  1  ATGGCTAACT GCTCTATAAT GATCGATGAA ATTATACATC ACTTAAAGAG     (SEQ ID NO:265)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTCAGGCC
451  CTGCAGCTGG CAGGCTGCTT GAGCCAACTC CATAGCGGCC TTTTCCTCTA
```

TABLE 2-continued

GENE SEQUENCES

```
501  CCAGGGGCTC CTGCAGGCCC TGGAAGGGAT ATCCCCCGAG TTGGGTCCCA
551  CCTTGGACAC ACTGCAGCTG GACGTCGCCG ACTTTGCCAC CACCATCTGG
601  CAGCAGATGG AAGAACTGGG AATGGCCCCT GCCCTGCAGC CCACCCAGGG
651  TGCCATGCCG GCCTTCGCCT CTGCTTTCCA GCGCCGGGCA GGAGGGGTCC
701  TGGTTGCTAG CCATCTGCAG AGCTTCCTGG AGGTGTCGTA CCGCGTTCTA
751  CGCCACCTTG CGCAGCCCGA CATGGCTACA CCATTAGGCC CTGCCAGCTC
801  CCTGCCCCAG AGCTTCCTGC TCAAGTCTTT AGAGCAAGTG AGGAAGATCC
851  AGGGCGATGG CGCAGCGCTC CAGGAGAAGC TGTGTGCCAC CTACAAGCTG
901  TGCCACCCCG AGGAGCTGGT GCTGCTCGGA CACTCTCTGG GCATCCCCTG
951  GGCTCCCCTG AGCTCCTGCC CCAGC
``` pmon16024.seq (SEQ ID NO:266)

```
  1  ATGGCTAACT GCTCTATAAT GATCGATGAA ATTATACATC ACTTAAAGAG
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTCTGCAG
451  CTGGCAGGCT GCTTGAGCCA ACTCCATAGC GGCCTTTTCC TCTACCAGGG
501  GCTCCTGCAG GCCCTGGAAG GGATATCCCC CGAGTTGGGT CCCACCTTGG
551  ACACACTGCA GCTGGACGTC GCCGACTTTG CCACCACCAT CTGGCAGCAG
601  ATGGAAGAAC TGGGAATGGC CCCTGCCCTG CAGCCCACCC AGGGTGCCAT
651  GCCGGCCTTC GCCTCTGCTT TCCAGCGCCG GGCAGGAGGG GTCCTGGTTG
701  CTAGCCATCT GCAGAGCTTC CTGGAGGTGT CGTACCGCGT TCTACGCCAC
751  CTTGCGCAGC CCGACATGGC TACACCATTA GGCCCTGCCA GCTCCCTGCC
801  CCAGAGCTTC CTGCTCAAGT CTTTAGAGCA AGTGAGGAAG ATCCAGGGCG
851  ATGGCGCAGC GCTCCAGGAG AAGCTGTGTG CCACCTACAA GCTGTGCCAC
901  CCCGAGGAGC TGGTGCTGCT CGGACACTCT CTGGGCATCC CCTGGGCTCC
951  CCTGAGCTCC TGCCCCAGCC AGGCC
``` pmon16025.seq (SEQ ID NO:267)

```
  1  ATGGCTAACT GCTCTATAAT GATCGATGAA ATTATACATC ACTTAAAGAG
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
```

TABLE 2-continued

GENE SEQUENCES

```
401  CGTCTCCTCC GTCTAAAGAA TCTCATAAAT CTCCAAACAT GGCTCTGGCA
451  GGCTGCTTGA GCCAACTCCA TAGCGGCCTT TTCCTCTACC AGGGGCTCCT
501  GCAGGCCCTG GAAGGGATAT CCCCCGAGTT GGGTCCCACC TTGGACACAC
551  TGCAGCTGGA CGTCGCCGAC TTTGCCACCA CCATCTGGCA GCAGATGGAA
601  GAACTGGGAA TGGCCCCTGC CCTGCAGCCC ACCCAGGGTG CCATGCCGGC
651  CTTCGCCTCT GCTTTCCAGC GCCGGGCAGG AGGGGTCCTG GTTGCTAGCC
701  ATCTGCAGAG CTTCCTGGAG GTGTCGTACC GCGTTCTACG CCACCTTGCG
751  CAGCCCGACA TGGCTACACC ATTAGGCCCT GCCAGCTCCC TGCCCCAGAG
801  CTTCCTGCTC AAGTCTTTAG AGCAAGTGAG GAAGATCCAG GGCGATGGCG
851  CAGCGCTCCA GGAGAAGCTG TGTGCCACCT ACAAGCTGTG CCACCCCGAG
901  GAGCTGGTGC TGCTCGGACA CTCTCTGGGC ATCCCTGGG CTCCCCTGAG
951  CTCCTGCCCC AGCCAGGCCC TGCAG
``` pmon16026.seq
```
  1  ATGGCTAACT GCTCTATAAT GATCGATGAA ATTATACATC ACTTAAAGAG    (SEQ ID NO:268)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTGAACTG
451  GGAATGGCCC CTGCCCTGCA GCCCACCCAG GGTGCCATGC CGGCCTTCGC
501  CTCTGCTTTC CAGCGCCGGG CAGGAGGGGT CCTGGTTGCT AGCCATCTGC
551  AGAGCTTCCT GGAGGTGTCG TACCGCGTTC TACGCCACCT TGCGCAGCCC
601  GACATGGCTA CACCATTAGG CCCTGCCAGC TCCCTGCCCC AGAGCTTCCT
651  GCTCAAGTCT TTAGAGCAAG TGAGGAAGAT CCAGGGCGAT GGCGCAGCGC
701  TCCAGGAGAA GCTGTGTGCC ACCTACAAGC TGTGCCACCC CGAGGAGCTG
751  GTGCTGCTCG GACACTCTCT GGGCATCCCC TGGGCTCCCC TGAGCTCCTG
801  CCCCAGCCAG GCCCTGCAGC TGGCAGGCTG CTTGAGCCAA CTCCATAGCG
851  GCCTTTTCCT CTACCAGGGG CTCCTGCAGG CCCTGGAAGG GATATCCCCC
901  GAGTTGGGTC CCACCTTGGA CACACTGCAG CTGGACGTCG CCGACTTTGC
951  CACCACCATC TGGCAGCAGA TGGAA
``` pmon16027.seq
```
  1  ATGGCTAACT GCTCTATAAT GATCGATGAA ATTATACATC ACTTAAAGAG    (SEQ ID NO:269)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
```

TABLE 2-continued

GENE SEQUENCES

```
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
351  CGGTGGAGGC TCCCCGGGTG AACCGTCTGG TCCAATCTCT ACTATCAACC
401  CGTCTCCTCC GTCTAAAGAA TCTCATAAAT CTCCAAACAT GGCTGGAATG
451  GCCCCTGCCC TGCAGCCCAC CCAGGGTGCC ATGCCGGCCT TCGCCTCTGC
501  TTTCCAGCGC CGGGCAGGAG GGGTCCTGGT TGCTAGCCAT CTGCAGAGCT
551  TCCTGGAGGT GTCGTACCGC GTTCTACGCC ACCTTGCGCA GCCCGACATG
601  GCTACACCAT TAGGCCCTGC CAGCTCCCTG CCCCAGAGCT TCCTGCTCAA
651  GTCTTTAGAG CAAGTGAGGA AGATCCAGGG CGATGGCGCA GCGCTCCAGG
701  AGAAGCTGTG TGCCACCTAC AAGCTGTGCC ACCCCGAGGA GCTGGTGCTG
751  CTCGGACACT CTCTGGGCAT CCCCTGGGCT CCCCTGAGCT CCTGCCCCAG
801  CCAGGCCCTG CAGCTGGCAG GCTGCTTGAG CCAACTCCAT AGCGGCCTTT
851  TCCTCTACCA GGGGCTCCTG CAGGCCCTGG AAGGGATATC AAAAGAGTTG
901  GGTCCCACCT TGGACACACT GCAGCTGGAC GTCGCCGACT TTGCCACCAC
951  CATCTGGCAG CAGATGGAAG AACTG
``` pmon16028.seq

```
  1  ATGGCTAACT GCTCTATAAT GATCGATGAA ATTATACATC ACTTAAAGAG      (SEQ ID NO:270)
 51  ACCACCTGCA CCTTTGCTGG ACCCGAACAA CCTCAATGAC GAAGACGTCT
101  CTATCCTGAT GGATCGAAAC CTTCGACTTC CAAACCTGGA GAGCTTCGTA
151  AGGGCTGTCA AGAACTTAGA AAATGCATCA GGTATTGAGG CAATTCTTCG
201  TAATCTCCAA CCATGTCTGC CCTCTGCCAC GGCCGCACCC TCTCGACATC
251  CAATCATCAT CAAGGCAGGT GACTGGCAAG AATTCCGGGA AAAACTGACG
301  TTCTATCTGG TTACCCTTGA GCAAGCGCAG GAACAACAGT ACGTAGAGGG
401  CGTCTCCTCC GTCTAAAGAA TCTCATAAAT CTCCAAACAT GGCTAGCTTC
451  CTGGAGGTGT CGTACCGCGT TCTACGCCAC CTTGCGCAGC CCGACATGGC
501  TACACCATTA GGCCCTGCCA GCTCCCTGCC CCAGAGCTTC CTGCTCAAGT
551  CTTTAGAGCA AGTGAGGAAG ATCCAGGGCG ATGGCGCAGC GCTCCAGGAG
601  AAGCTGTGTG CCACCTACAA GCTGTGCCAC CCCGAGGAGC TGGTGCTGCT
651  CGGACACTCT CTGGGCATCC CCTGGGCTCC CCTGAGCTCC TGCCCCAGCC
701  AGGCCCTGCA GCTGGCAGGC TGCTTGAGCC AACTCCATAG CGGCCTTTTC
751  CTCTACCAGG GGCTCCTGCA GGCCCTGGAA GGGATATCCC CCGAGTTGGG
801  TCCCACCTTG GACACACTGC AGCTGGACGT CGCCGACTTT GCCACCACCA
901  CAGGGTGCCA TGCCGGCCTT CGCCTCTGCT TTCCAGCGCC GGGCAGGAGG
951  GGTCCTGGTT GCTAGCCATC TGCAG
```

```
  1  ATGGCTGGAC CCACTTGCCT CTCATCCCTC CTGGGGCAGC TTTCTGGACA      (SEQ ID NO:286)
 51  GGTCCGTCTC CTCCTTGGGG CCCTGCAGAG CCTCCTTGGA ACCCAGCTTC
101  CTCCACAGGG CAGGACCACA GCTCACAAGG ATCCCAATGC CATCTTCCTG
151  AGCTTCCAAC ACCTGCTCCG AGGAAAGGTG CGTTTCCTGA TGCTTGTAGG
201  AGGGTCCACC CTCGCCGTCA GGGAATTCGG CGGCAACATG GCGTCTCCGG
```

TABLE 2-continued

GENE SEQUENCES

```
251  CGCCGCCTGC TGCTGACCTC CGAGTCCTCA GTAAACTGCT TCGTGACTCC

301  CATGTCCTTC ACAGCAGACT GAGCCAGTGC CCAGAGGTTC ACCCTTTGCC

351  TACACCTGTC CTGCTGCCTG CTGTGGACTT TAGCTTGGGA GAATGGAAAA

401  CCCAGATGGA GGAGACCAAG GCACAGGACA TTCTGGGAGC AGTGACCCTT

451  CTGCTGGAGG GAGTGATGGC AGCACGGGGA CAACTG

1  ATGGCTGGCA GGACCACAGC TCACAAGGAT CCCAATGCCA TCTTCCTGAG    (SEQ ID NO:287)

51  CTTCCAACAC CTGCTCCGAG GAAAGGTGCG TTTCCTGATG CTTGTAGGAG

101  GGTCCACCCT CGCCGTCAGG GAATTCGGCG GCAACATGGC GTCTCCGGCG

151  CCGCCTGCTG CTGACCTCCG AGTCCTCAGT AAACTGCTTC GTGACTCCCA

201  TGTCCTTCAC AGCAGACTGA GCCAGTGCCC AGAGGTTCAC CCTTTGCCTA

251  CACCTGTCCT GCTGCCTGCT GTGGACTTTA GCTTGGGAGA ATGGAAAACC

301  CAGATGGAGG AGACCAAGGC ACAGGACATT CTGGGAGCAG TGACCCTTCT

351  GCTGGAGGGA GTGATGGCAG CACGGGGACA ACTGGGACCC ACTTGCCTCT

401  CATCCCTCCT GGGGCAGCTT TCTGGACAGG TCCGTCTCCT CCTTGGGGCC

451  CTGCAGAGCC TCCTTGGAAC CCAGCTTCCT CCACAG
```

TABLE 3

PROTEIN SEQUENCES pMON26458pep
SerProAlaProProAlaCysAspLeuArgValLeuSerLysLeuLeuArgAspSerHis    (SEQ ID NO:161)

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsnAlaIlePheLeuSerPheGlnHisLeuLeuArgGlyLysValArg

PheLeuMetLeuValGlyGlySerThrLeuCysValArgGluPhe pMON28548pep
SerProAlaProProAlaCysAspLeuArgValLeuSerLysLeuLeuArgAspSerHis    (SEQ ID NO:162)

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsnAlaIlePheLeuSerPheGlnHisLeuLeuArgGlyLysValArg

PheLeuMetLeuValGlyGlySerThrLeuCysValArgGluPheGlyGlyAsnMetAla

SerProAlaProProAlaCysAspLeuArgValLeuSerLysLeuLeuArgAspSerHis

ValLeuHisSerArgLeuSerGlnCysProGluValHisProLeuProThrProValLeu

LeuProAlaValAspPheSerLeuGlyGluTrpLysThrGlnMetGluGluThrLysAla

TABLE 3-continued

PROTEIN SEQUENCES

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnGlyArgThrThrAlaHisLysAspPro

AsnAlaIlePheLeuSerPheGlnHisLeuLeuArgGlyLysValArgPheLeuMetLeu

ValGlyGlySerThrLeuCysValArg pMON28500
SerProAlaProProAlaCysAspLeuArgValLeuSerLysLeuLeuArgAspSerHisValLeu (SEQ ID NO:163)

HisSerArgLeuSerGlnCysProGluValHisProLeuProThrProValLeuLeuProAlaVal

AspPheSerLeuGlyGluTrpLysThrGlnMetGluGluThrLysAlaGlnAspIleLeuGlyAla

ValThrLeuLeuLeuGluGlyValMetAlaAlaArgGlyGlnLeuGlyProThrCysLeuSerSer

LeuLeuGlyGlnLeuSerGlyGlnValArgLeuLeuLeuGlyAlaLeuGlnSerLeuLeuGlyThr

GlnLeuProProGlnGlyArgThrThrAlaHisLysAspProAsnAlaIlePheLeuSerPheGln

HisLeuLeuArgGlyLysValArgPheLeuMetLeuValGlyGlySerThrLeuCysValArgGlu

PheGlyAsnMetAlaSerProAlaProProAlaCysAspLeuArgValLeuSerLysLeuLeuArg

AspSerHisValLeuHisSerArgLeuSerGlnCysProGluValHisProLeuProThrProVal

LeuLeuProAlaValAspPheSerLeuGlyGluTrpLysThrGlnMetGluGluThrLysAlaGln

AspIleLeuGlyAlaValThrLeuLeuLeuGluGlyValMetAlaAlaArgGlyGlnLeuGlyPro

ThrCysLeuSerSerLeuLeuGlyGlnLeuSerGlyGlnValArgLeuLeuLeuGlyAlaLeuGln

SerLeuLeuGlyThrGlnLeuProProGlnGlyArgThrThrAlaHisLysAspProAsnAlaIle

PheLeuSerPheGlnHisLeuLeuArgGlyLysValArgPheLeuMetLeuValGlyGlySerThr

LeuCysValArg pMON28501
SerProAlaProProAlaCysAspLeuArgValLeuSerLysLeuLeuArgAspSerHis (SEQ ID NO:164)

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsnAlaIlePheLeuSerPheGlnHisLeuLeuArgGlyLysValArg

PheLeuMetLeuValGlyGlySerThrLeuCysValArgGluPheGlyGlyAsnMetAla

SerProAlaProProAlaCysAspLeuArgValLeuSerLysLeuLeuArgAspSerHis

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsnAlaIlePheLeuSerPheGlnHisLeuLeuArgGlyLysValArg

PheLeuMetLeuValGlyGlySerThrLeuCysValArg pMON28502
SerProAlaProProAlaCysAspLeuArgValLeuSerLysLeuLeuArgAspSerHis (SEQ ID NO:165)

TABLE 3-continued

PROTEIN SEQUENCES

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsnAlaIlePheLeuSerPheGlnHisLeuLeuArgGlyLysValArg

PheLeuMetLeuValGlyGlySerThrLeuCysValArgGluPheGlyGlyAsnGlyGly

AsnMetAlaSerProAlaProProAlaCysAspLeuArgValLeuSerLysLeuLeuArg

AspSerHisValLeuHisSerArgLeuSerGlnCysProGluValHisProLeuProThr

ProValLeuLeuProAlaValAspPheSerLeuGlyGluTrpLysThrGlnMetGluGlu

ThrLysAlaGlnAspIleLeuGlyAlaValThrLeuLeuLeuGluGlyValMetAlaAla

ArgGlyGlnLeuGlyProThrCysLeuSerSerLeuLeuGlyGlnLeuSerGlyGlnVal

ArgLeuLeuLeuGlyAlaLeuGlnSerLeuLeuGlyThrGlnLeuProProGlnGlyArg

ThrThrAlaHisLysAspProAsnAlaIlePheLeuSerPheGlnHisLeuLeuArgGly

LysValArgPheLeuMetLeuValGlyGlySerThrLeuCysValArg

13182.Pept
Asn Cys Ser Ile Met Ile Asp Glu Ile Ile His His Leu Lys Arg  (SEQ ID NO:166)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr

13183.Pept
Asn Cys Ser Ile Met Ile Asp Glu Ile Ile His His Leu Lys Arg  (SEQ ID NO:167)

Pro Pro Ala Pro Leu Leu Asp Pro Asn Asn Leu Asn Asp Glu Asp

TABLE 3-continued

PROTEIN SEQUENCES

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr

13184.Pept
Asn Cys Ser Ile Met Ile Asp Glu Ile Ile His His Leu Lys Arg  (SEQ ID NO:168)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Ser Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

TABLE 3-continued

PROTEIN SEQUENCES

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser

13185.Pept
Asn Cys Ser Ile Met Ile Asp Glu Ile Ile His His Leu Lys Arg    (SEQ ID NO:169)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser

13186.Pept
Asn Cys Ser Ile Met Ile Asp Glu Ile Ile His His Leu Lys Arg    (SEQ ID NO:170)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

TABLE 3-continued

PROTEIN SEQUENCES

Ser Gly Gly Ser Gly Gly Ser Gln Ser Phe Leu Leu Lys Ser Leu

Glu Gln Val Arg Lys Ile Gln Gly Asp Gly Ala Ala Leu Gln Glu

Lys Leu Cys Ala Thr Tyr Lys Leu Cys His Pro Glu Glu Leu Val

Leu Leu Gly His Ser Leu Gly Ile Pro Trp Ala Pro Leu Ser Ser

Cys Pro Ser Gln Ala Leu Gln Leu Ala Gly Cys Leu Ser Gln Leu

His Ser Gly Leu Phe Leu Tyr Gln Gly Leu Leu Gln Ala Leu Glu

Gly Ile Ser Pro Glu Leu Gly Pro Thr Leu Asp Thr Leu Gln Leu

Asp Val Ala Asp Phe Ala Thr Thr Ile Trp Gln Gln Met Glu Glu

Leu Gly

13187.Pept
Asn Cys Ser Ile Met Ile Asp Glu Ile Ile His His Leu Lys Arg   (SEQ ID NO:171)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

Ser Gly Gly Ser Gly Gly Ser Gln Ser Phe Leu Leu Lys Ser Leu

Glu Gln Val Arg Lys Ile Gln Gly Asp Gly Ala Ala Leu Gln Glu

Lys Leu Cys Ala Thr Tyr Lys Leu Cys His Pro Glu Glu Leu Val

Leu Leu Gly His Ser Leu Gly Ile Pro Trp Ala Pro Leu Ser Ser

Cys Pro Ser Gln Ala Leu Gln Leu Ala Gly Cys Leu Ser Gln Leu

His Ser Gly Leu Phe Leu Tyr Gln Gly Leu Leu Gln Ala Leu Glu

Gly Ile Ser Pro Glu Leu Gly Pro Thr Leu Asp Thr Leu Gln Leu

Asp Val Ala Asp Phe Ala Thr Thr Ile Trp Gln Gln Met Glu Glu

Leu Gly

13188.Pept
Asn Cys Ser Ile Met Ile Asp Glu Ile Ile His His Leu Lys Arg   (SEQ ID NO:172)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Lys Ala Gly Asp Trp

Gln Glu Phe Arg Glu Lys Leu Thr Phe Tyr Leu Val Thr Leu Glu

TABLE 3-continued

PROTEIN SEQUENCES

Gln Ala Gln Glu Gln Gln Tyr Val Glu Gly Gly Gly Gly Ser Pro

Gly Gly Gly Ser Gly Gly Gly Ser Asn Met Ala Thr Gln Gly Ala

Met Pro Ala Phe Ala Ser Ala Phe Gln Arg Arg Ala Gly Gly Val

Leu Val Ala Ser His Leu Gln Ser Phe Leu Glu Val Ser Tyr Arg

Val Leu Arg His Leu Ala Gln Pro Ser Gly Gly Ser Gly Gly Ser

Gln Ser Phe Leu Leu Lys Ser Leu Glu Gln Val Arg Lys Ile Gln

Gly Asp Gly Ala Ala Leu Gln Glu Lys Leu Cys Ala Thr Tyr Lys

Leu Cys His Pro Glu Glu Leu Val Leu Leu Gly His Ser Leu Gly

Ile Pro Trp Ala Pro Leu Ser Ser Cys Pro Ser Gln Ala Leu Gln

Leu Ala Gly Cys Leu Ser Gln Leu His Ser Gly Leu Phe Leu Tyr

Gln Gly Leu Leu Gln Ala Leu Glu Gly Ile Ser Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro

13189.Pept
Asn Cys Ser Ile Met Ile Asp Glu Ile Ile His His Leu Lys Arg                    (SEQ ID NO:173)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Thr Gln Gly Ala

Met Pro Ala Phe Ala Ser Ala Phe Gln Arg Arg Ala Gly Gly Val

Leu Val Ala Ser His Leu Gln Ser Phe Leu Glu Val Ser Tyr Arg

Val Leu Arg His Leu Ala Gln Pro Ser Gly Gly Ser Gly Gly Ser

Gln Ser Phe Leu Leu Lys Ser Leu Glu Gln Val Arg Lys Ile Gln

Gly Asp Gly Ala Ala Leu Gln Glu Lys Leu Cys Ala Thr Tyr Lys

Leu Cys His Pro Glu Glu Leu Val Leu Leu Gly His Ser Leu Gly

Ile Pro Trp Ala Pro Leu Ser Ser Cys Pro Ser Gln Ala Leu Gln

Leu Ala Gly Cys Leu Ser Gln Leu His Ser Gly Leu Phe Leu Tyr

Gln Gly Leu Leu Gln Ala Leu Glu Gly Ile Ser Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro

13190.Pept
Asn Cys Ser Ile Met Ile Asp Glu Ile Ile His His Leu Lys Arg                    (SEQ ID NO:174)

TABLE 3-continued

PROTEIN SEQUENCES

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Gly Gly Ser Gly Gly Gly Ser Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser Pro Glu Leu Gly Pro Thr Leu Asp Thr Leu Gln Leu Asp

Val Ala Asp Phe Ala Thr Thr Ile Trp Gln Gln Met Glu Glu Leu

Gly Met Ala Pro Ala Leu Gln Pro Thr Gln Gly Ala Met Pro Ala

Phe Ala

13191.Pept
Asn Cys Ser Ile Met Ile Asp Glu Ile Ile His His Leu Lys Arg   (SEQ ID NO:175)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

TABLE 3-continued

PROTEIN SEQUENCES

Ile Ser Pro Glu Leu Gly Pro Thr Leu Asp Thr Leu Gln Leu Asp
Val Ala Asp Phe Ala Thr Thr Ile Trp Gln Gln Met Glu Glu Leu
Gly Met Ala Pro Ala Leu Gln Pro Thr Gln Gly Ala Met Pro Ala
Phe Ala

13192.Pept
Asn Cys Ser Ile Met Ile Asp Glu Ile Ile His His Leu Lys Arg    (SEQ ID NO:176)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Tyr Lys Leu Cys
His Pro Glu Glu Leu Val Leu Leu Gly His Ser Leu Gly Ile Pro
Trp Ala Pro Leu Ser Ser Cys Pro Ser Gln Ala Leu Gln Leu Ala
Gly Cys Leu Ser Gln Leu His Ser Gly Leu Phe Leu Tyr Gln Gly
Leu Leu Gln Ala Leu Glu Gly Ile Ser Pro Glu Leu Gly Pro Thr
Leu Asp Thr Leu Gln Leu Asp Val Ala Asp Phe Ala Thr Thr Ile
Trp Gln Gln Met Glu Glu Leu Gly Met Ala Pro Ala Leu Gln Pro
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Thr Pro Leu
Gly Pro Ala Ser Ser Leu Pro Gln Ser Phe Leu Leu Lys Ser Leu
Glu Gln Val Arg Lys Ile Gln Gly Asp Gly Ala Ala Leu Gln Glu
Lys Leu Cys Ala Thr 13193.Pept
Asn Cys Ser Ile Met Ile Asp Glu Ile Ile His His Leu Lys Arg    (SEQ ID NO:177)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Tyr Lys Leu Cys
His Pro Glu Glu Leu Val Leu Leu Gly His Ser Leu Gly Ile Pro
Trp Ala Pro Leu Ser Ser Cys Pro Ser Gln Ala Leu Gln Leu Ala
Gly Cys Leu Ser Gln Leu His Ser Gly Leu Phe Leu Tyr Gln Gly

TABLE 3-continued

PROTEIN SEQUENCES

Leu Leu Gln Ala Leu Glu Gly Ile Ser Pro Glu Leu Gly Pro Thr
Leu Asp Thr Leu Gln Leu Asp Val Ala Asp Phe Ala Thr Thr Ile
Trp Gln Gln Met Glu Glu Leu Gly Met Ala Pro Ala Leu Gln Pro
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Thr Pro Leu
Gly Pro Ala Ser Ser Leu Pro gln Ser Phe Leu Leu Lys Ser Leu
Glu Gln Val Arg Lys Ile Gln Gly Asp Gly Ala Ala Leu Gln Glu
Lys Leu Cys Ala Thr 25190.Pept
Asn Cys Ser Ile Met Ile Asp Glu Ile Ile His His leu Lys Arg      (SEQ ID NO:178)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val lys Asn leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Pro Glu Leu Gly
Pro Thr Leu Asp Thr Leu Gln Leu Asp Val Ala Asp Phe Ala Thr
Thr Ile Trp Gln Gln Met Glu Glu leu Gly Met Ala Pro Ala Leu
Gln Pro Thr Gln Gly Ala Met Pro Ala Phe Ala Ser Ala Phe Gln
Arg Arg Ala Gly Gly Val Leu Val Ala Ser His leu Gln Ser Phe
Leu Glu Val Ser Tyr Arg Val Leu Arg His Leu Ala Gln Pro Thr
Pro Leu Gly Pro Ala Ser Ser Leu Pro Gln Ser Phe Leu Leu Lys
Ser Leu Glu gln Val Arg Lys Ile Gln Gly Asp Gly Ala Ala Leu
Gln Glu Lys Leu Cys Ala Thr Tyr Lys Leu Cys his Pro Glu Glu
Leu Val Leu Leu Gly His Ser Leu Gly Ile Pro Trp Ala Pro Leu
Ser Ser Cys Pro Ser Gln Ala Leu Gln Leu Ala Gly Cys Leu Ser
Gln Leu His Ser Gly Leu Phe Leu Tyr Gln Gly Leu Leu Gln Ala
Leu Glu Gly Ile Ser pMON25191.Pep
Asn Cys Ser Ile Met Ile Asp Glu Ile Ile His His Leu Lys Arg      (SEQ ID NO:179)
Pro Pro Ala Pro Leu Leu Asp Pro Asn Asn Leu Asn Asp Glu Asp
Val Ser Ile Leu Met Asp Arg Asn Leu Arg leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu

TABLE 3-continued

PROTEIN SEQUENCES

Gln Ala Gln Glu Gln Gln Tyr Val Glu Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro Thr Gln Gly Ala Met Pro Ala Phe Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Thr
Pro Leu Gly Pro Ala Ser Ser Leu Pro Gln Ser Phe Leu Leu Lys
Ser Leu Glu Gln Val Arg Lys Ile Gln Gly Asp Gly Ala Ala Leu
Gln Glu Lys Leu Cys Ala Thr Tyr Lys Leu Cys His Pro Glu Glu
Leu Val Leu Leu Gly His Ser Leu Gly Ile Pro Trp Ala Pro Leu
Ser Ser Cys Pro Ser Gln Ala Leu Gln Leu Ala Gly Cys Leu Ser
Gln leu His Ser Gly Leu Phe Leu Tyr Gln Gly Leu Leu Gln Ala
Leu Glu Gly Ile Ser 13194.Pept
Asn Cys Ser Ile Met Ile Asp Glu Ile Ile His His Leu Lys Arg    (SEQ ID NO:180)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro
Thr Pro Leu Gly Pro Ala Ser Ser Leu Pro Gln Ser Phe Leu Leu
Lys Ser Leu Glu Gln Val Arg Lys Ile Gln Gly Asp Gly Ala Ala
Leu Gln Glu Lys Leu Cys Ala Thr Tyr Lys Leu Cys His Pro Glu
Glu Leu Val Leu Leu Gly His Ser Leu Gly Ile Pro Trp Ala Pro
Leu Ser Ser Cys Pro Ser Gln Ala Leu Gln Leu Ala Gly Cys Leu
Ser Gln Leu His Ser Gly Leu Phe Leu Tyr Gln Gly Leu Leu Gln
Ala Leu Glu Gly Ile Ser Pro Glu Leu Gly Pro Thr Leu Asp Thr
Leu Gln Leu Asp Val Ala Asp Phe Ala Thr Thr Ile Trp Gln Gln
Met Glu Glu Leu Gly 13195.Pept
Asn Cys Ser Ile Met Ile Asp Glu Ile Ile His His Leu Lys Arg    (SEQ ID NO:181)
Pro Pro Ala Pro Leu Leu Asp Pro Asn Asn Leu Asn Asp Glu Asp

TABLE 3-continued

PROTEIN SEQUENCES

Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro
Thr Pro Leu Gly Pro Ala Ser Ser Leu Pro Gln Ser Phe Leu Leu
Lys Ser Leu Glu Gln Val Arg Lys Ile Gln Gly Asp Gly Ala Ala
Leu Gln Glu Lys Leu Cys Ala Thr Tyr Lys Leu Cys His Pro Glu
Glu Leu Val Leu Leu Gly His Ser Leu Gly Ile Pro Trp Ala Pro
Leu Ser Ser Cys Pro Ser Gln Ala Leu Gln Leu Ala Gly Cys Leu
Ser Gln Leu His Ser Gly Leu Phe Leu Tyr Gln Gly Leu Leu Gln
Ala Leu Glu Gly Ile Ser Pro Glu Leu Gly Pro Thr Leu Asp Thr
Leu Gln Leu Asp Val Ala Asp Phe Ala Thr Thr Ile Trp Gln Gln
Met Glu Glu Leu Gly

13196 Pept
Asn Cys Ser Ile Met Ile Asp Glu Ile Ile His His Leu Lys Arg         (SEQ ID NO:182)
Pro Pro Ala Pro Leu Leu Asp Pro Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Ser Asn Met Ala Thr Gln Gly Ala
Met Pro Ala Phe Ala Ser Ala Phe Gln Arg Arg Ala Gly Gly Val
Leu Val Ala Ser His Leu Gln Ser Phe Leu Glu Val Ser Tyr Arg
Val Leu Arg His Leu Ala Gln Pro Thr Pro Leu Gly Pro Ala Ser
Ser Leu Pro Gln Ser Phe Leu Leu Lys Ser Leu Glu Gln Val Arg
Lys Ile Gln Gly Asp Gly Ala Ala Leu Gln Glu Lys Leu Cys Ala
Thr Tyr Lys Leu Cys His Pro Glu Glu Leu Val Leu Leu Gly His
Ser Leu Gly Ile Pro Trp Ala Pro Leu Ser Ser Cys Pro Ser Gln
Ala Leu Gln Leu Ala Gly Cys Leu Ser Gln Leu His Ser Gly Leu
Phe Leu Tyr Gln Gly Leu Leu Gln Ala Leu Glu Gly Ile Ser Pro

TABLE 3-continued

PROTEIN SEQUENCES

Glu Leu Gly Pro Thr Leu Asp Thr Leu Gln Leu Asp Val Ala Asp

Phe Ala Thr Thr Ile Trp Gln Gln Met Glu Glu Leu Gly Met Ala

Pro Ala Leu Gln Pro

13197.Pept
Asn Cys Ser Ile Met Ile Asp Glu Ile Ile His His Leu Lys Arg     (SEQ ID NO:183)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Thr Gln Gly Ala

Met Pro Ala Phe Ala Ser Ala Phe Gln Arg Arg Ala Gly Gly Val

Leu Val Ala Ser His Leu Gln Ser Phe Leu Glu Val Ser Tyr Arg

Val Leu Arg His Leu Ala Gln Pro Thr Pro Leu Gly Pro Ala Ser

Ser Leu Pro Gln Ser Phe Leu Leu Lys Ser Leu Glu Gln Val Arg

Lys Ile Gln Gly Asp Gly Ala Ala Leu Gln Glu Lys Leu Cys Ala

Thr Tyr Lys Leu Cys His Pro Glu Glu Leu Val Leu Leu Gly His

Ser Leu Gly Ile Pro Trp Ala Pro Leu Ser Ser Cys Pro Ser Gln

Ala Leu Gln Leu Ala Gly Cys Leu Ser Gln Leu His Ser Gly Leu

Phe Leu Tyr Gln Gly Leu Leu Gln Ala Leu Glu Gly Ile Ser Pro

Glu Leu Gly Pro Thr Leu Asp Thr Leu Gln Leu Asp Val Ala Asp

Phe Ala Thr Thr Ile Trp Gln Gln Met Glu Glu Leu Gly Met Ala

Pro Ala Leu Gln Pro

13198.Pept
Asn Cys Ser Ile Met Ile Asp Glu Ile Ile His His Leu Lys Arg     (SEQ ID NO:184)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

TABLE 3-continued

PROTEIN SEQUENCES

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser Pro Glu Leu Gly Pro Thr Leu Asp Thr Leu

Gln Leu Asp Val Ala Asp Phe Ala Thr Thr Ile Trp Gln Gln Met

Glu Glu Leu Gly Met Ala Pro Ala Leu Gln Pro Thr Gln Gly Ala

Met Pro Ala Phe Ala

13199.Pept
Asn Cys Ser Ile Met Ile Asp Glu Ile Ile His His Leu Lys Arg    (SEQ ID NO:185)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser Pro Glu Leu Gly Pro Thr Leu Asp Thr Leu

Gln Leu Asp Val Ala Asp Phe Ala Thr Thr Ile Trp Gln Gln Met

Glu Glu Leu Gly Met Ala Pro Ala Leu Gln Pro Thr Gln Gly Ala

Met Pro Ala Phe Ala

31104.Pep
Leu Asp Pro Asn Asn Leu Asn Asp Glu Asp Val Ser Ile Leu Met    (SEQ ID NO:186)

Asp Arg Asn Leu Arg Leu Pro Asn Leu Glu Ser Phe Val Arg Ala

Val Lys Asn Leu Glu Asn Ala Ser Gly Ile Glu Ala Ile Leu Arg

Asn Leu Gln Pro Cys Leu Pro Ser Ala Thr Ala Ala Pro Ser Arg

His Pro Ile Ile Ile Lys Ala Gly Asp Trp Gln Glu Phe Arg Glu

Lys Leu Thr Phe Tyr Leu Val Thr Leu Glu Gln Ala Gln Glu Gln

Gln Gly Gly Gly Ser Asn Cys Ser Ile Met Ile Asp Glu Ile Ile

TABLE 3-continued

PROTEIN SEQUENCES

His His Leu Lys Arg Pro Pro Ala Pro Leu Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly
His Ser Leu Gly Ile Pro Trp Ala Pro Leu Ser Ser Cys Pro Ser
Gln Ala Leu Gln Leu Ala Gly Cys Leu Ser Gln Leu His Ser Gly
Leu Phe Leu Tyr Gln Gly Leu Leu Gln Ala Leu Glu Gly Ile Ser
Pro Glu Leu Gly Pro Thr Leu Asp Thr Leu Gln Leu Asp Val Ala
Asp Phe Ala Thr Thr Ile Trp Gln Gln Met Glu Glu Leu Gly Met
Ala Pro Ala Leu Gln Pro

31105.Pep
Asn Ala Ser Gly Ile Glu Ala Ile Leu Arg Asn Leu Gln Pro Cys  (SEQ ID NO:187)
Leu Pro Ser Ala Thr Ala Ala Pro Ser Arg His Pro Ile Ile Ile
Lys.Ala Gly Asp Trp Gln Glu Phe Arg Glu Lys Leu Thr Phe Tyr
Leu Val Thr Leu Glu Gln Ala Gln Glu Gln Gln Gly Gly Gly Ser
Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly
His Ser Leu Gly Ile Pro Trp Ala Pro Leu Ser Ser Cys Pro Ser
Gln Ala Leu Gln Leu Ala Gly Cys Leu Ser Gln Leu His Ser Gly
Leu Phe Leu Tyr Gln Gly Leu Leu Gln Ala Leu Glu Gly Ile Ser
Pro Glu Leu Gly Pro Thr Leu Asp Thr Leu Gln Leu Asp Val Ala
Asp Phe Ala Thr Thr Ile Trp Gln Gln Met Glu Glu Leu Gly Met
Ala Pro Ala Leu Gln Pro

31106 Pep

TABLE 3-continued

PROTEIN SEQUENCES

Ala Pro Ser Arg His Pro Ile Ile Ile Lys Ala Gly Asp Trp Gln  (SEQ ID NO:188)
Glu Phe Arg Glu Lys Leu Thr Phe Tyr Leu Val Thr Leu Glu Gln
Ala Gln Glu Gln Gln Gly Gly Ser Asn Cys Ser Ile Met Ile
Asp Glu Ile Ile His His Leu Lys Arg Pro Pro Ala Pro Leu Leu
Asp Pro Asn Asn Leu Asn Asp Glu Asp Val Ser Ile Leu Met Asp
Arg Asn Leu Arg Leu Pro Asn Leu Glu Ser Phe Val Arg Ala Val
Lys Asn Leu Glu Asn Ala Ser Gly Ile Glu Ala Ile Leu Arg Asn
Leu Gln Pro Cys Leu Pro Ser Ala Thr Ala Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly
His Ser Leu Gly Ile Pro Trp Ala Pro Leu Ser Ser Gys Pro Ser
Gln Ala Leu Gln Leu Ala Gly Cys Leu Ser Gln Leu His Ser Gly
Leu Phe Leu Tyr Gln Gly Leu Leu Gln Ala Leu Glu Gly Ile Ser
Pro Glu Leu Gly Pro Thr Leu Asp Thr Leu Gln Leu Asp Val Ala
Asp Phe Ala Thr Thr Ile Trp Gln Gln Met Glu Glu Leu Gly Met
Ala Pro Ala Leu Gln Pro

31107.Pep
Ala Gly Asp Trp Gln Glu Phe Arg Glu Lys Leu Thr Phe Tyr Leu  (SEQ ID NO:189)
Val Thr Leu Glu Gln Ala Gln Glu Gln Gln Gly Gly Ser Asn
Cys Ser Ile Met Ile Asp Glu Ile Ile His His Leu Lys Arg Pro
Pro Ala Pro Leu Leu Asp Pro Asn Asn Leu Asn Asp Glu Asp Val
Ser Ile Leu Met Asp Arg Asn Leu Arg Leu Pro Asn Leu Glu Ser
Phe Val Arg Ala Val Lys Asn Leu Glu Asn Ala Ser Gly Ile Glu
Ala Ile Leu Arg Asn Leu Gln Pro Cys Leu Pro Ser Ala Thr Ala
Ala Pro Ser Arg His Pro Ile Ile Ile Lys Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly

TABLE 3-continued

PROTEIN SEQUENCES

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro

31108.Pep
Leu Asp Pro Asn Asn Leu Asn Asp Glu Asp Val Ser Ile Leu Met   (SEQ ID NO:190)

Asp Arg Asn Leu Arg Leu Pro Asn Leu Glu Ser Phe Val Arg Ala

Val Lys Asn Leu Glu Asn Ala Ser Gly Ile Glu Ala Ile Leu Arg

Asn Leu Gln Pro Cys Leu Pro Ser Ala Thr Ala Ala Pro Ser Arg

His Pro Ile Ile Ile Lys Ala Gly Asp Trp Gln Glu Phe Arg Glu

Lys Leu Thr Phe Tyr Leu Val Thr Leu Glu Gln Ala Gln Glu Gln

Gln Gly Gly Gly Ser Gly Gly Gly Ser Gly Gly Gly Ser Asn Cys

Ser Ile Met Ile Asp Glu Ile Ile His His Leu Lys Arg Pro Pro

Ala Pro Leu Tyr Val Glu Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro

31109.Pep
Asn Ala Ser Gly Ile Glu Ala Ile Leu Arg Asn Leu Gln Pro Cys   (SEQ ID NO:191)

Leu Pro Ser Ala Thr Ala Ala Pro Ser Arg His Pro Ile Ile Ile

Lys Ala Gly Asp Trp Gln Glu Phe Arg Glu Lys Leu Thr Phe Tyr

Leu Val Thr Leu Glu Gln Ala Gln Glu Gln Gln Gly Gly Gly Ser

Gly Gly Gly Ser Gly Gly Gly Ser Asn Cys Ser Ile Met Ile Asp

Glu Ile Ile His His Leu Lys Arg Pro Pro Ala Pro Leu Leu Asp

Pro Asn Asn Leu Asn Asp Glu Asp Val Ser Ile Leu Met Asp Arg

Asn Leu Arg Leu Pro Asn Leu Glu Ser Phe Val Arg Ala Val Lys

Asn Leu Glu Tyr Val Glu Gly Gly Gly Ser Pro Gly Glu Pro

Ser Gly Pro Ile Ser Thr Ile Asn Pro Ser Pro Pro Ser Lys Glu

TABLE 3-continued

PROTEIN SEQUENCES

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro

31110.Pep
Ala Pro Ser Arg His Pro Ile Ile Ile Lys Ala Gly Asp Trp Gln       (SEQ ID NO:192)

Glu Phe Arg Glu Lys Leu Thr Phe Tyr Leu Val Thr Leu Glu Gln

Ala Gln Glu Gln Gln Gly Gly Gly Ser Gly Gly Gly Ser Gly Gly

Gly Ser Asn Cys Ser Ile Met Ile Asp Glu Ile Ile His His Leu

Lys Arg Pro Pro Ala Pro Leu Leu Asp Pro Asn Asn Leu Asn Asp

Glu Asp Val Ser Ile Leu Met Asp Arg Asn Leu Arg Leu Pro Asn

Leu Glu Ser Phe Val Arg Ala Val Lys Asn Leu Glu Asn Ala Ser

Gly Ile Glu Ala Ile Leu Arg Asn Leu Gln Pro Cys Leu Pro Ser

Ala Thr Ala Tyr Val Glu Gly Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro

31111.Pep
Ala Gly Asp Trp Gln Glu Phe Arg Glu Lys Leu Thr Phe Tyr Leu       (SEQ ID NO:193)

Val Thr Leu Glu Gln Ala Gln Glu Gln Gln Gly Gly Gly Ser Gly

Gly Gly Ser Gly Gly Gly Ser Asn Cys Ser Ile Met Ile Asp Glu

TABLE 3-continued

PROTEIN SEQUENCES

Ile Ile His His Leu Lys Arg Pro Pro Ala Pro Leu Leu Asp Pro

Asn Asn Leu Asn Asp Glu Asp Val Ser Ile Leu Met Asp Arg Asn

Leu Arg Leu Pro Asn Leu Glu Ser Phe Val Arg Ala Val Lys Asn

Leu Glu Asn Ala Ser Gly Ile Glu Ala Ile Leu Arg Asn Leu Gln

Pro Cys Leu Pro Ser Ala Thr Ala Ala Pro Ser Arg His Pro Ile

Ile Ile Lys Tyr Val Glu Gly Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro pMON15981
MetAlaAsnCysSerIleMetIleAspGluIleIleHisHisLeuLysArgProProAla  (SEQ ID NO:194)

ProLeuLeuAspProAsnAsnLeuAsnAspGluAspValSerIleLeuMetAspArgAsn

LeuArgLeuProAsnLeuGluSerPheValArgAlaValLysAsnLeuGluAsnAlaSer

GlyIleGluAlaIleLeuArgAsnLeuGlnProCysLeuProSerAlaThrAlaAlaPro

SerArgHisProIleIleIleLysAlaGlyAspTrpGlnGluPheArgGluLysLeuThr

PheTyrLeuValThrLeuGluGlnAlaGlnGluGlnGlnTyrValGluGlyGlyGlyGly

SerProGlyGluProSerGlyProIleSerThrIleAsnProSerProProSerLysGlu

SerHisLysSerProAsnMetAlaTyrLysLeuCysHisProGluGluLeuValLeuLeu

GlyHisSerLeuGlyIleProTrpAlaProLeuSerSerCysProSerGlnAlaLeuGln

LeuAlaGlyCysLeuSerGlnLeuHisSerGlyLeuPheLeuTyrGlnGlyLeuLeuGln

AlaLeuGluGlyIleSerProGluLeuGlyProThrLeuAspThrLeuGlnLeuAspVal

AlaAspPheAlaThrThrIleTrpGlnGlnMetGluGluLeuGlyMetAlaProAlaLeu

GlnProThrGlnGlyAlaMetProAlaPheAlaSerAlaPheGlnArgArgAlaGlyGly

ValLeuValAlaSerHisLeuGlnSerPheLeuGluValSerTyrArgValLeuArgHis

LeuAlaGlnProGlyGlyGlySerAspMetAlaThrProLeuGlyProAlaSerSerLeu

ProGlnSerPheLeuLeuLysSerLeuGluGlnValArgLysIleGlnGlyAspGlyAla

AlaLeuGlnGluLysLeuCysAlaThr pMON15982
MetAlaAsnCysSerIleMetIleAspGluIleIleHisHisLeuLysArgProProAla  (SEQ ID NO:195)

ProLeuLeuAspProAsnAsnLeuAsnAspGluAspValSerIleLeuMetAspArgAsn

TABLE 3-continued

PROTEIN SEQUENCES

LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr
PheTyrLeuValThrLeuGluGlnAlaGlnGluGlnGlnTyrValGluGlyGlyGlyGly
SerProGlyGluProSerGlyProIleSerThrIleAsnProSerProProSerLysGlu
SerHisLysSerProAsnMetAlaProGluLeuGlyProThrLeuAspThrLeuGlnLeu
AspValAlaAspPheAlaThrThrIleTrpGlnGlnMetGluGluLeuGlyMetAlaPro
AlaLeuGlnProThrGlnGlyAlaMetProAlaPheAlaSerAlaPheGlnArgArgAla
GlyGlyValLeuValAlaSerHisLeuGlnSerPheLeuGluValSerTyrArgValLeu
ArgHisLeuAlaGlnProGlyGlyGlySerAspMetAlaThrProLeuGlyProAlaSer
SerLeuProGlnSerPheLeuLeuLysSerLeuGluGlnValArgLysIleGlnGlyAsp
GlyAlaAlaLeuGlnGluLysLeuCysAlaThrTyrLysLeuCysHisProGluGluLeu
ValLeuLeuGlyHisSerLeuGlyIleProTrpAlaProLeuSerSerCysProSerGln
AlaLeuGlnLeuAlaGlyCysLeuSerGlnLeuHisSerGlyLeuPheLeuTyrGlnGly
LeuLeuGlnAlaLeuGluGlyIleSer pMON15965
MetAlaAsnCysSerIleMetIleAspGluIleIleHisHisLeuLysArgProProAla    (SEQ ID NO:196)
ProLeuLeuAspProAsnAsnLeuAsnAspGluAspValSerIleLeuMetAspArgAsn
LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr
PheTyrLeuValThrLeuGluGlnAlaGlnGluGlnGlnTyrValGluGlyGlyGlyGly
SerProGlyGluProSerGlyProIleSerThrIleAsnProSerProProSerLysGlu
SerHisLysSerProAsnMetAlaSerAlaPheGlnArgArgAlaGlyGlyValLeuVal
AlaSerHisLeuGlnSerPheLeuGluValSerTyrArgValLeuArgHisLeuAlaGln
ProGlyGlyGlySerAspMetAlaThrProLeuGlyProAlaSerSerLeuProGlnSer
PheLeuLeuLysSerLeuGluGlnValArgLysIleGlnGlyAspGlyAlaAlaLeuGln
GluLysLeuCysAlaThrTyrLysLeuCysHisProGluGluLeuValLeuLeuGlyHis
SerLeuGlyIleProTrpAlaProLeuSerSerCysProSerGlnAlaLeuGlnLeuAla
GlyCysLeuSerGlnLeuHisSerGlyLeuPheLeuTyrGlnGlyLeuLeuGlnAlaLeu
GluGlyIleSerProGluLeuGlyProThrLeuAspThrLeuGlnLeuAspValAlaAsp
PheAlaThrThrIleTrpGlnGlnMetGluGluLeuGlyMetAlaProAlaLeuGlnPro
ThrGlnGlyAlaMetProAlaPheAla pMON15966
MetAlaAsnCysSerIleMetIleAspGluIleIleHisHisLeuLysArgProProAla    (SEQ ID NO:197)
ProLeuLeuAspProAsnAsnLeuAsnAspGluAspValSerIleLeuMetAspArgAsn
LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr

TABLE 3-continued

PROTEIN SEQUENCES

PheTyrLeuValThrLeuGluGlnAlaGlnGluGlnGlnTyrValGluGlyGlyGlyGly

SerProGlyGluProSerGlyProIleSerThrIleAsnProSerProProSerLysGlu

SerHisLysSerProAsnMetAlaMetAlaProAlaLeuGlnProThrGlnGlyAlaMet

ProAlaPheAlaSerAlaPheGlnArgArgAlaGlyGlyValLeuValAlaSerHisLeu

GlnSerPheLeuGluValSerTyrArgValLeuArgHisLeuAlaGlnProGlyGlyGly

SerAspMetAlaThrProLeuGlyProAlaSerSerLeuProGlnSerPheLeuLeuLys

SerLeuGluGlnValArgLysIleGlnGlyAspGlyAlaAlaLeuGlnGluLysLeuCys

AlaThrTyrLysLeuCysHisProGluGluLeuValLeuLeuGlyHisSerLeuGlyIle

ProTrpAlaProLeuSerSerCysProSerGlnAlaLeuGlnLeuAlaGlyCysLeuSer

GlnLeuHisSerGlyLeuPheLeuTyrGlnGlyLeuLeuGlnAlaLeuGluGlyIleSer

ProGluLeuGlyProThrLeuAspThrLeuGlnLeuAspValAlaAspPheAlaThrThr

IleTrpGlnGlnMetGluGluLeuGly pMON15967
MetAlaAsnCysSerIleMetIleAspGluIleIleHisHisLeuLysArgProProAla   (SEQ ID NO:198)

ProLeuLeuAspProAsnAsnLeuAsnAspGluAspValSerIleLeuMetAspArgAsn

LeuArgLeuProAsnLeuGluSerPheValArgAlaValLysAsnLeuGluAsnAlaSer

GlyIleGluAlaIleLeuArgAsnLeuGlnProCysLeuProSerAlaThrAlaAlaPro

SerProGlyGluProSerGlyProIleSerThrIleAsnProSerProProSerLysGlu

SerHisLysSerProAsnMetAlaThrGlnGlyAlaMetProAlaPheAlaSerAlaPhe

GlnArgArgAlaGlyGlyValleuValAlaSerHisLeuGlnSerPheLeuGluValSer

TyrArgValLeuArgHisLeuAlaGlnProGlyGlyGlySerAspMetAlaThrProLeu

GlyProAlaSerSerLeuProGlnSerPheLeuLeuLysSerLeuGluGlnValArgLys

IleGlnGlyAspGlyAlaAlaLeuGlnGluLysLeuCysAlaThrTyrLysLeuCysHis

ProGluGluLeuValLeuLeuGlyHisSerLeuGlyIleProTrpAlaProLeuSerSer

CysProSerGlnAlaLeuGlnLeuAlaGlyCysLeuSerGlnLeuHisSerGlyLeuPhe

LeuTyrGlnGlyLeuLeuGlnAlaLeuGluGlyIleSerProGluLeuGlyProThrLeu

AspThrLeuGlnLeuAspValAlaAspPheAlaThrThrIleTrpGlnGlnMetGluGlu

LeuGlyMetAlaProAlaLeuGlnPro pMON31112 .pep
MetAlaAsnCysSerAsnMetIleAspGluIleIleThrHisLeuLysGlnProProLeu   (SEQ ID NO:199)

ProLeuLeuAspPheAsnAsnLeuAsnGlyGluAspGlnAspIleLeuMetAspAsnAsn

LeuArgArgProAsnLeuGluAlaPheAsnArgAlaVallysSerleuGlnAsnAlaSer

AlaIleGluSerIleLeulysAsnLeuLeuProCysLeuProLeuAlaThrAlaAlaPro

ThrArgHisProIleHisIleLysAspGlyAspTrpAsnGluPheArgArgLysLeuThr

PheTyrLeuLysThrLeuGluAsnAlaGlnAlaGlnGlnTyrValGluGlyGlyGlyGly

SerProGlyGluProSerGlyProIleSerThrIleAsnProSerProProSerLysGlu

SerHisLysSerProAsnMetAlaThrGlnGlyAlaMetProAlaPheAlaSerAlaPhe

GlnArgArgAlaGlyGlyValLeuValAlaSerHisLeuGlnserPheLeuGluValSer

TyrArgValLeuArgHisLeuAlaGlnProSerGlyGlySerGlyGlySerGlnSerPhe

LeuLeuLysSerLeuGluGlnValArgLysIleGlnGlyAspGlyAlaAlaLeuGlnGlu

TABLE 3-continued

PROTEIN SEQUENCES

LysLeuCysAlaThrTyrLysLeuCysHisProGluGluLeuValLeuLeuGlyHisSer

LeuGlyIleProTrpAlaproLeuSerSerCysProSerglnAlaLeuGlnLeuAlaGly

CysLeuSerGlnLeuHisSerGlyLeuPheLeuTyrGlnGlyLeuLeuGlnAlaLeuGlu

GlyIleSerProGluLeuGlyProThrLeuAspThrLeuGlnLeuAspValAlaAspPhe

AlaThrThrIleTrpGlnGlnMetGluGluLeuGlyMetAlaProAlaLeuGlnPro pMON31113.pep
MetAlaAsnCysSerAsnMetIleAspGluIleIleThrHisLeuLysGlnProProLeu          (SEQ ID NO:200)

ProLeuLeuAspPheAsnAsnLeuAsnGlyGluAspGlnAspIleLeuMetGluAsnAsn

LeuArgArgProAsnLeuGluAlaPheAsnArgAlaValLysSerLeuGlnAsnAlaSer

AlaIleGluSerIleLeuLysAsnLeuLeuproCysLeuProLeuAlaThrAlaAlaPro

ThrArgHisProIleIleIleArgAspGlyAspTrpAsnGluPheArgArgLysLeuThr

PheTyrLeuLysThrLeuLeuAsnAlaGlnAlaGlnGlnTyrValGluGlyGlyGlyGly

SerProGlyGluProSerGlyProIleSerThrIleAsnProSerProProSerLysGlu

SerHisLysSerProAsnMetAlaThrGlnGlyAlaMetProAlaPheAlaSerAlaPhe

GlnArgArgAlaGlyGlyValLeuValAlaSerHisLeuGlnSerPheLeuGluValSer

TyrArgValLeuArgHisLeuAlaGlnProThrProLeuGlyProAlaSerSerLeuPro

GlnSerPheLeuLeuLysSerLeuGluGlnValArgLysIleGlnGlyAspGlyAlaAla

LeuGlnGluLysLeuCysAlaThrTyrLysLeuCysHisProGluGluLeuValLeuLeu

GlyHisSerLeuGlyIleProTrpAlaProLeuSerSerCysProSerGlnAlaLeuGln

LeuAlaGlyCysLeuSerGlnLeuHisSerGlyLeuPheLeuTyrGlnGlyLeuLeuGln

AlaLeuGluGlyIleSerProGluLeuGlyProThrLeuAspThrLeuGlnLeuAspVal

AlaAspPheAlaThrThrIleTrpGlnGlnMetGluGluLeuGlyMetAlaProAlaLeu

GlnPro

PMON31114.pep
MetAlaAsnCysSerAsnMetIleAspGluIleIleThrHisLeuLysGlnProProLeu          (SEQ ID NO:201)

ProLeuLeuAspPheAsnAsnLeuAsnGlyGluAspGlnAspIleLeuMetGluAsnAsn

LeuArgArgProAsnLeuGluAlaPheAsnArgAlaValLysSerLeuGlnAsnAlaSer

AlaIleGluSerIleLeuLysAsnLeuLeuProCysLeuProLeuAlaThrAlaAlaPro

ThrArgHisProIleIleIleArgAspGlyAspTrpAsnGluPheArgArgLysLeuThr

PheTyrLeuLysThrLeuGluAsnAlaGlnAlaGlnGlnTyrValGluGlyGlyGlyGly

SerProGlyGluProSerGlyProIleSerThrIleAsnProSerProProSerLysGlu

SerHisLysSerProAsnMetAlaThrGlnGlyAlaMetProAlaPheAlaSerAlaPhe

GlnArgArgAlaGlyGlyValLeuValAlaSerHisLeuGlnSerPheLeuGluValSer

TyrArgValLeuArgHisLeuAlaGlnProSerGlyGlySerGlyGlySerGlnSerPhe

LeuLeuLysSerLeuGluGlnValArgLysIleGlnGlyAspGlyAlaAlaLeuGlnGlu

LysLeuCysAlaThrTyrLysLeuCysHisProGluGluLeuValLeuLeuGlyHisSer

LeuGlyIleProTrpAlaProLeuSerSerCysProSerGlnAlaLeuGlnLeuAlaGly

CysLeuSerGlnLeuHisSerGlyLeuPheLeuTyrGlnGlyLeuLeuGlnAlaLeuGlu

GlyIleSerProGluLeuGlyProThrLeuAspThrLeuGlnLeuAspValAlaAspPhe

TABLE 3-continued

PROTEIN SEQUENCES

AlaThrThrIleTrpGlnGlnMetGluGluLeuGlyMetAlaProAlaLeuGlnPro pMON31115.pep
MetAlaAsnCysSerAsnMetIleAspGluIleIleThrHisLeuLysGlnProProLeu  (SEQ ID NO:202)

ProLeuLeuAspPheAsnAsnLeuAsnGlyGluAspGlnAspIleLeuMetAspAsnAsn

LeuArgArgProAsnLeuGluAlaPheAsnArgAlaValLysSerLeuGlnAsnAlaSer

AlaIleGluSerIleLeuLysAsnLeuLeuProCysLeuProLeuAlaThrAlaAlaPro

ThrArgHisProIleHisIleLysAspGlyAspTrpAsnGluPheArgArgLysLeuThr

PheTyrLeuLysThrLeuGluAsnAlaGlnAlaGlnGlnTyrValGluGlyGlyGlyGly

SerProGlyGluProSerGlyProIleSerThrIleAsnProSerProProSerLysGlu

SerHisLysSerProAsnMetAlaThrGlnGlyAlaMetProAlaPheAlaSerAlaPhe

GlnArgArgAlaGlyGlyValLeuValAlaSerHisLeuGlnSerPheLeuGluValSer

TyrArgValLeuArgHisLeuAlaGlnProThrProLeuGlyProAlaSerSerLeuPro

GlnSerPheLeuLeuLysSerLeuGluGlnValArgLysIleGlnGlyAspGlyAlaAla

LeuGlnGluLysLeuCysAlaThrTyrLysLeuCysHisProGluGluLeuValLeuLeu

GlyHisSerLeuGlyIleProTrpAlaProLeuSerSerCysProSerGlnAlaLeuGln

LeuAlaGlyCysLeuSerGlnLeuHisSerGlyLeuPheLeuTyrGlnGlyLeuLeuGln

AlaLeuGluGlyIleSerProGluLeuGlyProThrLeuAspThrLeuGlnLeuAspVal

AlaAspPheAlaThrThrIleTrpGlnGlnMetGluGluLeuGlyMetAlaProAlaLeu

GlnPro pMON28505
AlaAsnCysSerIleMetIleAspGluIleIleHisHisLeuLysArgProProAlaPro  (SEQ ID NO:203)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGluValHisProLeuProThrProValLeuLeuProAlaVal

AspPheSerLeuGlyGluTrpLysThrGlnMetGluGluThrLysAlaGlnAspIleLeu

GlyAlaValThrLeuLeuLeuGluGlyValMetAlaAlaArgGlyGlnLeuGlyProThr

CysLeuSerSerLeuLeuGlyGlnLeuSerGlyGlnValArgLeuLeuLeuGlyAlaLeu

GlnSerLeuLeuGlyThrGlnLeuProProGlnGlyArgThrThrAlaHisLysAspPro

AsnAlaIlePheLeuSerPheGlnHisLeuLeuArgGlyLysValArgPheLeuMetLeu

ValGlyGlySerThrLeuCysValArgGluPheGlyGlyAsnMetAlaSerProAlaPro

ProAlaCysAspLeuArgValLeuSerLysLeuLeuArgAspSerHisValLeuHisSer

ArgLeuSerGlnCysPro pMON28506
AlaAsnCysSerIleMetIleAspGluIleIleHisHisLeuLysArgProProAlaPro  (SEQ ID NO:204)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

TABLE 3-continued

PROTEIN SEQUENCES

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetLeuProThrProValLeuLeuProAlaValAspPheSerLeu

GlyGluTrpLysThrGlnMetGluGluThrLysAlaGlnAspIleLeuGlyAlaValThr

LeuLeuLeuGluGlyValMetAlaAlaArgGlyGlnLeuGlyProThrCysLeuSerSer

LeuLeuGlyGlnLeuSerGlyGlnValArgLeuLeuLeuGlyAlaLeuGlnSerLeuLeu

GlyThrGlnLeuProProGlnGlyArgThrThrAlaHisLysAspProAsnAlaIlePhe

LeuSerPheGlnHisLeuLeuArgGlyLysValArgPheLeuMetLeuValGlyGlySer

ThrLeuCysValArgGluPheGlyGlyAsnMetAlaSerProAlaProProAlaCysAsp

LeuArgValLeuSerLysLeuLeuArgAspSerHisValLeuHisSerArgLeuSerGln

CysProGluValHisPro pMON28507
AlaAsnCysSerIleMetIleAspGluIleIleHisHisLeuLysArgProProAlaPro    (SEQ ID NO:205)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaproSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetValLeuLeuProAlaValAspPheSerLeuGlyGluTrpLys

ThrGlnMetGluGluThrLysAlaGlnAspIleLeuGlyAlaValThrLeuLeuLeuGlu

GlyValMetAlaAlaArgGlyGlnLeuGlyProThrCysLeuSerSerLeuLeuGlyGln

LeuSerGlyGlnValArgLeuLeuLeuGlyAlaLeuGlnSerLeuLeuGlyThrGlnLeu

ProProGlnGlyArgThrThrAlaHislysAspProAsnAlaIlePheLeuSerPheGln

HisLeuLeuArgGlyLysValArgPheLeuMetLeuValGlyGlySerThrLeuCysVal

ArgGluPheGlyGlyAsnMetAlaSerProAlaProProAlaCysAspLeuArgValLeu

SerLysLeuLeuArgAspSerHisValLeuHisSerArgLeuSerGlnCysProGluVal

HisProLeuProThrPro pMON28508
AlaAsnCysSerIleMetIleAspGluIleIleHisHisLeuLysArgProProAlaPro    (SEQ ID NO:206)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAlaValAspPheSerLeuGlyGluTrpLysThrGlnMetGlu

GluThrLysAlaGluAspIleLeuGlyAlaValThrLeuLeuLeuGluGlyValMetAla

TABLE 3-continued

PROTEIN SEQUENCES

AlaArgGlyGlnLeuGlyProThrCysLeuSerSerLeuLeuGlyGlnLeuSerGlyGln

ValArgLeuLeuLeuGlyAlaLeuGlnSerLeuLeuGlyThrGlnLeuProProGlnGly

ArgThrThrAlaHisLysAspProAsnAlaIlePheLeuSerPheGlnHisLeuLeuArg

GlyLysValArgPheLeuMetLeuValGlyGlySerThrLeuCysValArgGluPheGly

GlyAsnMetAlaSerProAlaProProAlaCysAspLeuArgValLeuSerLysLeuLeu

ArgAspSerHisValLeuHisSerArgLeuSerGlnCysProGluValHisProLeuPro

ThrProValLeuLeuPro pMON28509
AlaAsnCysSerIleMetIleAspGluIleIleHisHisLeuLysArgProProAlaPro (SEQ ID NO:207)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAspPheSerLeuGlyGluTrpLysThrGlnMetGluGluThr

LysAlaGlnAspIleLeuGlyAlaValThrLeuLeuLeuGluGlyValMetAlaAlaArg

GlyGlnLeuGlyProThrCysLeuSerSerLeuLeuGlyGlnLeuSerGlyGlnValArg

LeuLeuLeuGlyAlaLeuGlnSerLeuLeuGlyThrGlnLeuProProGlnGlyArgThr

ThrAlaHisLysAspProAsnAlaIlePheLeuSerPheGlnHisLeuLeuArgGlyLys

ValArgPheLeuMetLeuValGlyGlySerThrLeuCysValArgGluPheGlyGlyAsn

MetAlaSerProAlaProProAlaCysAspLeuArgValLeuSerLysLeuLeuArgAsp

SerHisValLeuHisSerArgLeuSerGlnCysProGluValHisProLeuProThrPro

ValLeuLeuProAlaVal pMON28510
AlaAsnCysSerIleMetIleAspGluIleIleHisHisLeuLysArgProProAlaPro (SEQ ID NO:208)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyGluTrpLysThrGlnMetGluGluThrLysAlaGlnAsp

IleLeuGlyAlaValThrLeuLeuLeuGluGlyValMetAlaAlaArgGlyGlnLeuGly

ProThrCysLeuSerSerLeuLeuGlyGlnLeuSerGlyGlnValArgLeuLeuLeuGly

AlaLeuGlnSerLeuLeuGlyThrGlnLeuProProGlnGlyArgThrThrAlaHisLys

AspProAsnAlaIlePheLeuSerPheGlnHisLeuLeuArgGlyLysValArgPheLeu

MetLeuValGlyGlySerThrLeuCysValArgGluPheGlyGlyAsnMetAlaSerPro

AlaProProAlaCysAspLeuArgValLeuSerLysLeuLeuArgAspSerHisValLeu

TABLE 3-continued

PROTEIN SEQUENCES

HisSerArgLeuSerGlnCysProGluValHisProLeuProThrProValLeuLeuPro

AlaValAspPheSerLeu pMON28511
AlaAsnCysSerIleMetIleAspGluIleIleHisHisLeuLysArgProProAlaPro  (SEQ ID NO:209)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyProThrCysLeuSerSerLeuLeuGlyGlnLeuSerGly

GlnValArgLeuLeuGlyAlaLeuGlnSerLeuLeuGlyThrGlnleuProProGln

GlyArgThrThrAlaHisLysAspProAsnAlaIlePheLeuSerPheGlnHisLeuLeu

ArgGlyLysValArgPheLeuMetLeuValGlyGlySerThrLeuCysValArgGluPhe

GlyGlyAsnMetAlaSerProAlaProProAlaCysAspLeuArgValLeuSerLysLeu

LeuArgAspSerHisValLeuHisSerArgLeuSerGlnCysProGluValHisProLeu

ProThrProValLeuLeuProAlaValAspPheSerLeuGlyGluTrpLysThrGlnMet

GluGluThrLysAlaGlnAspIleLeuGlyAlaValThrLeuLeuLeuGluGlyValMet

AlaAlaArgGlyGlnLeu pMON28512
AlaAsnCysSerIleMetIleAspGluIleIleHisHisLeuLysArgProProAlaPro  (SEQ ID NO:210)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyThrGlnLeuProProGlnGlyArgThrThrAlaHisLys

AspProAsnAlaIlePheLeuSerPheGlnHisLeuLeuArgGlyLysValArgPheLeu

MetLeuValGlyGlySerThrLeuCysValArgGluPheGlyGlyAsnMetAlaSerPro

AlaProProAlaCysAspLeuArgValLeuSerLysLeuLeuArgAspSerHisValLeu

HisSerArgLeuSerGlnCysProGluValHisProLeuProThrProValLeuLeuPro

AlaValAspPheSerLeuGlyGluTrpLysThrGlnMetGluGluThrLysAlaGlnAsp

IleLeuGlyAlaValThrLeuLeuLeuGluGlyValMetAlaAlaArgGlyGlnLeuGly

ProThrCysLeuSerSerLeuLeuGlyGlnLeuSerGlyGlnValArgLeuLeuLeuGly

AlaLeuGlnSerLeuLeu pMON28513
AlaAsnCysSerIleMetIleAspGluIleIleHisHisLeuLysArgProProAlaPro  (SEQ ID NO:211)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

TABLE 3-continued

PROTEIN SEQUENCES

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyArgThrThrAlaHisLysAspProAsnAlaIlePheLeu

SerPheGlnHisLeuLeuArgGlyLysValArgPheLeuMetLeuValGlyGlySerThr

LeuCysValArgGluPheGlyGlyAsnMetAlaSerProAlaProProAlaCysAspLeu

ArgValLeuSerLysLeuLeuArgAspSerHisValLeuHisSerArgLeuSerGlnCys

ProGluValHisProLeuProThrProValLeuLeuProAlaValAspPheSerLeuGly

GluTrpLysThrGlnMetGluGluThrLysAlaGlnAspIleLeuGlyAlaValThrLeu

LeuLeuGluGlyValMetAlaAlaArgGlyGlnLeuGlyProThrCysLeuSerSerLeu

LeuGlyGlnLeuSerGlyGlnValArgLeuLeuLeuGlyAlaLeuGlnSerLeuLeuGly

ThrGlnLeuProProGln pMON28514
AlaAsnCysSerIleMetIleAspGluIleIleHisHisLeuLysArgProProAlaPro  (SEQ ID NO:212)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAlaHisLysAspProAsnAlaIlePheLeuSerPheGlnHis

LeuLeuArgGlyLysValArgPheLeuMetLeuValGlyGlySerThrLeuCysValArg

GluPheGlyGlyAsnMetAlaSerProAlaProProAlaCysAspLeuArgValLeuSer

LysLeuLeuArgAspSerHisValLeuHisSerArgLeuSerGlnCysProGluValHis

ProLeuProThrProValLeuLeuProAlaValAspPheSerLeuGlyGluTrpLysThr

GlnMetGluGluThrLysAlaGlnAspIleLeuGlyAlaValThrLeuLeuLeuGluGly

ValMetAlaAlaArgGlyGlnLeuGlyProThrCysLeuSerSerLeuLeuGlyGlnLeu

SerGlyGlnValArgLeuLeuLeuGlyAlaLeuGlnSerLeuLeuGlyThrGlnLeuPro

ProGlnGlyArgThrThr pMON28515
AlaAsnCysSerIleMetIleAspGluIleIleHisHisLeuLysArgProProAlaPro  (SEQ ID NO:213)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAspProAsnAlaIlePheLeuSerPheGlnHisLeuLeuArg

GlyLysValArgPheLeuMetLeuValGlyGlySerThrLeuCysValArgGluPheGly

TABLE 3-continued

PROTEIN SEQUENCES

GlyAsnMetAlaSerProAlaProProAlaCysAspLeuArgValLeuSerLysLeuLeu
ArgAspSerHisValLeuHisSerArgLeuSerGlnCysProGluValHisProLeuPro
ThrProValLeuLeuProAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnLeuProProGlnGly
ArgThrThrAlaHisLys pMON28516
AlaAsnCysSerIleMetIleAspGluIleIleHisHisLeuLysArgProProAlaPro  (SEQ ID NO:214)
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGlnAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaIlePheLeuSerPheGlnHisLeuLeuArgGlyLysVal
ArgPheLeuMetLeuValGlyGlySerThrLeuCysValArgGluPheGlyGlyAsnMet
AlaSerProAlaProProAlaCysAspLeuArgValLeuSerLysLeuLeuArgAspSer
HisValLeuHisSerArgLeuSerGlnCysProGluValHisProLeuProThrProVal
LeuLeuProAlaValAspPheSerLeuGlyGluTrpLysThrGlnMetGluGluThrLys
AlaGlnAspIleLeuGlyAlaValThrLeuLeuLeuGluGlyValMetAlaAlaArgGly
GlnLeuGlyProThrCysLeuSerSerLeuLeuGlyGlnLeuSerGlyGlnValArgLeu
LeuLeuGlyAlaLeuGlnSerLeuLeuGlyThrGlnLeuProProGlnGlyArgThrThr
AlaHisLysAspProAsn pMON28519
AlaAsnCysSerIleMetIleAspGluIleIleHisHisLeuLysArgProProAlaPro  (SEQ ID NO:215)
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGluAlaGlnGluGlnGlnTyrValGluGlyGlyGlyGlySer
ProGlyGluProSerGlyProIleSerThrIleAsnProSerProProSerLysGluSer
HisLysSerProAsnMetGluValHisProLeuProThrProValLeuLeuProAlaVal
AspPheSerLeuGlyGluTrpLysThrGlnMetGluGluThrLysAlaGlnAspIleLeu
GlyAlaValThrLeuLeuLeuGluGlyValMetAlaAlaArgGlyGlnLeuGlyProThr
CysLeuSerSerLeuLeuGlyGlnLeuSerGlyGlnValArgLeuLeuLeuGlyAlaLeu
GlnSerLeuLeuGlyThrGlnLeuProProGlnGlyArgThrThrAlaHisLysAspPro
AsnAlaIlePheLeuSerPheGlnHisLeuLeuArgGlyLysValArgPheLeuMetLeu
ValGlyGlySerThrLeuCysValArgGluPheGlyGlyAsnMetAlaSerProAlaProPro

TABLE 3-continued

PROTEIN SEQUENCES

AlaCysAspLeuArgValLeuSerLysLeuLeuArgAspSerHisValLeuHisSerArg

LeuSerGlnCysPro pMON28520
AlaAsnCysSerIleMetIleAspGluIleIleHisHisLeuLysArgProProAlaPro        (SEQ ID NO:216)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetLeuProThrProValLeuLeuProAlaValAspPheSerLeu

GlyGluTrpLysThrGlnMetGluGluThrLysAlaGlnAspIleLeuGlyAlaValThr

LeuLeuLeuGluGlyValMetAlaAlaArgGlyGlnLeuGlyProThrCysLeuSerSer

LeuLeuGlyGlnLeuSerGlyGlnValArgLeuLeuLeuGlyAlaLeuGlnSerLeuLeu

GlyThrGlnLeuProProGlnGlyArgThrThrAlaHisLysAspProAsnAlaIlePhe

LeuSerPheGlnHisLeuLeuArgGlyLysValArgPheLeuMetLeuValGlyGlySer

ThrLeuCysValArgGluPheGlyAsnMetAlaSerProAlaProProAlaCysAspLeu

ArgValLeuSerLysLeuLeuArgAspSerHisValLeuHisSerArgLeuSerGlnCys

ProGluValHisPro pMON28521
AlaAsnCysSerIleMetIleAspGluIleIleHisHisLeuLysArgProProAlaPro        (SEQ ID NO:217)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetValLeuLeuProAlaValAspPheSerLeuGlyGluTrpLys

ThrGlnMetGluGluThrLysAlaGlnAspIleLeuGlyAlaValThrLeuLeuLeuGlu

GlyValMetAlaAlaArgGlyGlnLeuGlyProThrCysLeuSerSerLeuLeuGlyGln

LeuSerGlyGlnValArgLeuLeuLeuGlyAlaLeuGlnSerLeuLeuGlyThrGlnLeu

ProProGlnGlyArgThrThrAlaHisLysAspProAsnAlaIlePheLeuSerPheGln

HisLeuLeuArgGlyLysValArgPheLeuMetLeuValGlyGlySerThrLeuCysVal

ArgGluPheGlyAsnMetAlaSerProAlaProProAlaCysAspLeuArgValLeuSer

LysLeuLeuArgAspSerHisValLeuHisSerArgLeuSerGlnCysProGluValHis

ProLeuProThrPro pMON28522
AlaAsnCysSerIleMetIleAspGluIleIleHisHisLeuLysArgProProAlaPro        (SEQ ID NO:218)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

TABLE 3-continued

PROTEIN SEQUENCES

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAlaValAspPheSerLeuGlyGluTrpLysThrGlnMetGlu

GluThrLysAlaGlnkspIleLeuGlyAlaValThrLeuLeuLeuGluGlyValMetAla

AlaArgGlyGlnLeuGlyProThrCysLeuSerSerLeuLeuGlyGlnLeuSerGlyGln

ValArgLeuLeuLeuGlyAlaLeuGlnSerLeuLeuGlyThrGlnLeuProProGlnGly

ArgThrThrAlaHisLysAspProAsnAlaIlePheLeuSerPheGlnHisLeuLeuArg

GlyLysValArgPheLeuMetLeuValGlyGlySerThrLeuCysValArgGluPheGly

AsnMetAlaSerProAlaProProAlaCysAspLeuArgValLeuSerLysLeuLeuArg

AspSerHisValLeuHisSerArgLeuSerGlnCysProGluValHisProLeuProThr

ProValLeuLeuPro pMON28523
AlaAsnCysSerIleMetIleAspGluIleIleHisHisLeuLysArgProProAlaPro          (SEQ ID NO:219)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGlnAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAspPheSerLeuGlyGluTrpLysThrGlnMetGluGluThr

LysAlaGlnAspIleLeuGlyAlaValThrLeuLeuLeuGluGlyValMetAlaAlaArg

GlyGlnLeuGlyProThrCysLeuSerSerLeuLeuGlyGlnLeuSerGlyGlnValArg

LeuLeuLeuGlyAlaLeuGlnSerLeuLeuGlyThrGlnLeuProProGlnGlyArgThr

ThrAlaHisLysAspProAsnAlaIlePheLeuSerPheGlnHisLeuLeuArgGlyLys

ValArgPheLeuMetLeuValGlyGlySerThrLeuCysValArgGluPheGlyAsnMet

AlaSerProAlaProProAlaCysAspLeuArgValLeuSerLysLeuLeuArgAspSer

HisValLeuHisSerArgLeuSerGlnCysProGluValHisProLeuProThrProVal

LeuLeuProAlaVal pMON28524
AlaAsnCysSerIleMetIleAspGluIleIleHisHisLeuLysArgProProAlaPro          (SEQ ID NO:220)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyGluTrpLysThrGlnMetGluGluThrLysAlaGlnAsp

IleLeuGlyAlaValThrLeuLeuLeuGluGlyValMetAlaAlaArgGlyGlnLeuGly

TABLE 3-continued

PROTEIN SEQUENCES

ProThrCysLeuSerSerLeuLeuGlyGlnLeuSerGlyGlnValArgLeuLeuLeuGly

AlaLeuGlnSerLeuLeuGlyThrGlnLeuProProGlnGlyArgThrThrAlaHisLys

AspProAsnAlaIlePheLeuSerPheGlnHisLeuLeuArgGlyLysValArgPheLeu

MetLeuValGlyGlySerThrLeuCysValArgGluPheGlyAsnMetAlaSerProAla

ProProAlaCysAspLeuArgValLeuSerLysLeuLeuArgAspSerHisValLeuHis

SerArgLeuSerGlnCysProGluValHisProLeuProThrProValLeuLeuProAla

ValAspPheSerLeu pMON28525
AlaAsnCysSerIleMetIleAspGluIleIleHisHisLeuLysArgProProAlaPro          (SEQ ID NO:221)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyProThrCysLeuSerSerLeuLeuGlyGlnLeuSerGly

GlnValArgLeuLeuLeuGlyAlaLeuGlnSerLeuLeuGlyThrGlnLeuProProGln

GlyArgThrThrAlaHisLysAspProAsnAlaIlePheLeuSerPheGlnHisLeuLeu

ArgGlyLysValArgPheLeuMetLeuValGlyGlySerThrLeuCysValArgGluPhe

GlyAsnMetAlaSerProAlaProProAlaCysAspLeuArgValLeuSerLysLeuLeu

ArgAspSerHisValLeuHisSerArgLeuSerGlnCysProGluValHisProLeuPro

ThrProValLeuLeuProAlaValAspPheSerLeuGlyGluTrpLysThrGlnMetGlu

GluThrLysAlaGlnAspIleLeuGlyAlaValThrLeuLeuLeuGluGlyValMetAla

AlaArgGlyGlnLeu pMON28526
AlaAsnCysSerIleMetIleAspGluIleIleHisHisLeuLysArgProProAlaPro          (SEQ ID NO:222)

LeuLeuAspProAsnAsnLeuAsnAspGluAspValSerIleLeuMetAspArgAsnLeu

ArgLeuProAsnLeuGluSerPheValArgAlaValLysAsnLeuGlnAsnAlaSerGly

IleGlnAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyThrGlnLeuProProGlnGlyArgThrThrAlaHisLys

AspProAsnAlaIlePheLeuSerPheGlnHisLeuLeuArgGlyLysValArgPheLeu

MetLeuValGlyGlySerThrLeuCysValArgGluPheGlyAsnMetAlaSerProAla

ProProAlaCysAspLeuArgValLeuSerLysLeuLeuArgAspSerHisValLeuHis

SerArgLeuSerGlnCysProGluValHisProLeuProThrProValLeuLeuProAla

ValAspPheSerLeuGlyGluTrpLysThrGlnMetGluGluThrLysAlaGlnAspIle

LeuGlyAlaValThrLeuLeuLeuGluGlyValMetAlaAlaArgGlyGlnLeuGlyPro

TABLE 3-continued

| PROTEIN SEQUENCES | |
|---|---|
| ThrCysLeuSerSerLeuLeuGlyGlnLeuSerGlyGlnValArgLeuLeuLeuGlyAla | |
| LeuGlnSerLeuLeu | |
| pMON28527<br>AlaAsnCysSerIleMetIleAspGluIleIleHisHisLeuLysArgProProAlaPro | (SEQ ID NO:223) |
| LeuLeuAspProAsnAsnLeuAsnAspGluAspValSerIleLeuMetAspArgAsnLeu | |
| ArgLeuProAsnLeuGluSerPheValArgAlaValLysAsnLeuGluAsnAlaSerGly | |
| IleGluAlaIleLeuArgAsnLeuGlnProCysLeuProSerAlaThrAlaAlaProSer | |
| ArgHisProIleIleIleLysAlaGlyAspTrpGlnGluPheArgGluLysLeuThrPhe | |
| TyrLeuValThrLeuGluGlnAlaGlnGluGlnGlnTyrValGluGlyGlyGlyGlySer | |
| ProGlyGluProSerGlyProIleSerThrIleAsnProSerProProSerLysGluSer | |
| HisLysSerProAsnMetGlyArgThrThrAlaHisLysAspProAsnAlaIlePheLeu | |
| SerPheGlnHisLeuLeuArgGlyLysValArgPheLeuMetLeuValGlyGlySerThr | |
| LeuCysValArgGluPheGlyAsnMetAlaSerProAlaProProAlaCysAspLeuArg | |
| ValLeuSerLysLeuLeuArgAspSerHisValLeuHisSerArgLeuSerGlnCysPro | |
| GluValHisProLeuProThrProValLeuLeuProAlaValAspPheSerLeuGlyGlu | |
| TrpLysThrGlnMetGluGluThrLysAlaGlnAspIleLeuGlyAlaValThrLeuLeu | |
| LeuGluGlyValMetAlaAlaArgGlyGlnLeuGlyProThrCysLeuSerSerLeuLeu | |
| GlyGlnLeuSerGlyGlnValArgLeuLeuLeuGlyAlaLeuGlnSerLeuLeuGlyThr | |
| GlnLeuProProGln | |
| pMON28528<br>AlaAsnCysSerIleMetIleAspGluIleIleHisHisLeuLysArgProProAlaPro | (SEQ ID NO:224) |
| LeuLeuAspProAsnAsnLeuAsnAspGluAspValSerIleLeuMetAspArgAsnLeu | |
| ArgLeuProAsnLeuGluSerPheValArgAlaValLysAsnLeuGluAsnAlaSerGly | |
| IleGluAlaIleLeuArgAsnLeuGlnProCysLeuProSerAlaThrAlaAlaProSer | |
| ArgHisProIleIleIleLysAlaGlyAspTrpGlnGluPheArgGluLysLeuThrPhe | |
| TyrLeuValThrLeuGluGlnAlaGlnGluGlnGlnTyrValGluGlyGlyGlyGlySer | |
| ProGlyGluProSerGlyProIleSerThrIleAsnProSerProProSerLysGluSer | |
| HisLysSerProAsnMetAlaHisLysAspProAsnAlaIlePheLeuSerPheGlnHis | |
| LeuLeuArgGlyLysValArgPheLeuMetLeuValGlyGlySerThrLeuCysValArg | |
| GluPheGlyAsnMetAlaSerProAlaProProAlaCysAspLeuArgValLeuSerLys | |
| LeuLeuArgAspSerHisValLeuHisSerArgLeuSerGlnCysProGluValHisPro | |
| LeuProThrProValLeuLeuProAlaValAspPheSerLeuGlyGluTrpLysThrGln | |
| MetGluGluThrLysAlaGlnAspIleLeuGlyAlaValThrLeuLeuLeuGluGlyVal | |
| MetAlaAlaArgGlyGlnLeuGlyProThrCysLeuSerSerLeuLeuGlyGlnLeuSer | |
| GlyGlnValArgLeuLeuLeuGlyAlaLeuGlnSerLeuLeuGlyThrGlnLeuProPro | |
| GlnGlyArgThrThr | |
| pMON28529<br>AlaAsnCysSerIleMetIleAspGluIleIleHisHisLeuLysArgProProAlaPro | (SEQ ID NO:225) |
| LeuLeuAspProAsnAsnLeuAsnAspGluAspValSerIleLeuMetAspArgAsnLeu | |
| ArgLeuProAsnLeuGluSerPheValArgAlaValLysAsnLeuGluAsnAlaSerGly | |

TABLE 3-continued

PROTEIN SEQUENCES

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAspProAsnAlaIlePheLeuSerPheGlnHisLeuLeuArg

GlyLysValArgPheLeuMetLeuValGlyGlySerThrLeuCysValArgGluPheGly

AsnMetAlaSerProAlaProProAlaCysAspLeuArgValLeuSerLysLeuLeuArg

AspSerHisValLeuHisSerArgLeuSerGlnCysProGluValHisProLeuProThr

ProValLeuLeuProAlaValAspPheSerLeuGlyGluTrpLysThrGlnMetGluGlu

ThrLysAlaGlnAspIleLeuGlyAlaValThrLeuLeuLeuGluGlyValMetAlaAla

ArgGlyGlnLeuGlyProThrCysLeuSerSerLeuLeuGlyGlnLeuSerGlyGlnVal

ArgLeuLeuLeuGlyAlaLeuGlnSerLeuLeuGlyThrGlnLeuProProGlnGlyArg

ThrThrAlaHisLys pMON28530
AlaAsnCysSerIleMetIleAspGluIleIleHisHisLeuLysArgProProAlaPro  (SEQ ID NO:226)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAlaIlePheLeuSerPheGlnHisLeuLeuArgGlyLysVal

ArgPheLeuMetLeuValGlyGlySerThrLeuCysValArgGluPheGlyAsnMetAla

SerProAlaProProAlaCysAspLeuArgValLeuSerLysLeuLeuArgAspSerHis

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsn pMON28533
AlaAsnCysSerIleMetIleAspGluIleIleHisHisLeuLysArgProProAlaPro  (SEQ ID NO:227)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnThrValGluGlyGlyGlyGlySer

ProGlyGluProSerGlyProIleSerThrIleAsnProSerProProSerLysGluSer

HisLysSerProAsnMetGluValHisProLeuProThrProValLeuLeuProAlaVal

AspPheSerLeuGlyGluTrpLysThrGlnMetGluGluThrLysAlaGlnAspIleLeu

TABLE 3-continued

PROTEIN SEQUENCES

GlyAlaValThrLeuLeuLeuGluGlyValMetAlaAlaArgGlyGlnLeuGlyProThr

CysLeuSerSerLeuLeuGlyGlnLeuSerGlyGlnValArgLeuLeuLeuGlyAlaLeu

GlnSerLeuLeuGlyThrGlnLeuProProGlnGlyArgThrThrAlaHisLysAspPro

AsnAlaIlePheLeuSerPheGlnHisLeuLeuArgGlyLysValArgPheLeuMetLeu

ValGlyGlySerThrLeuCysValArgGluPheGlyGlyAsnGlyGlyAsnMetAlaSer

ProAlaProProAlaCysAspLeuArgValLeuSerLysLeuLeuArgAspSerHisVal

LeuHisSerArgLeuSerGlnCysPro pMON28534
AlaAsnCysSerIleMetIleAspGluIleIleHisHisLeuLysArgProProAlaPro     (SEQ ID NO:228)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGlnAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetLeuProThrProValLeuLeuProAlaValAspPheSerLeu

GlyGluTrpLysThrGlnMetGluGluThrLysAlaGlnAspIleLeuGlyAlaValThr

LeuLeuLeuGluGlyValMetAlaAlaArgGlyGlnLeuGlyProThrCysLeuSerSer

LeuLeuGlyGlnLeuSerGlyGlnValArgLeuLeuLeuGlyAlaLeuGlnSerLeuLeu

GlyThrGlnLeuProProGlnGlyArgThrThrAlaHisLysAspProAsnAlaIlePhe

LeuSerPheGlnHisLeuLeuArgGlyLysValArgPheLeuMetLeuValGlyGlySer

ThrLeuCysValArgGluPheGlyGlyAsnGlyGlyAsnMetAlaSerProAlaProPro

AlaCysAspLeuArgValLeuSerLysLeuLeuArgAspSerHisValLeuHisSerArg

LeuSerGlnCysProGluValHisPro pMON28535
AlaAsnCysSerIleMetIleAspGluIleIleHisHisLeuLysArgProProAlaPro     (SEQ ID NO:229)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetValLeuLeuProAlaValAspPheSerLeuGlyGluTrpLys

ThrGlnMetGluGluThrLysAlaGlnAspIleLeuGlyAlaValThrLeuLeuLeuGlu

GlyValMetAlaAlaArgGlyGlnLeuGlyProThrCysLeuSerSerLeuLeuGlyGln

LeuSerGlyGlnValArgLeuLeuLeuGlyAlaLeuGlnSerLeuLeuGlyThrGlnLeu

ProProGlnGlyArgThrThrAlaHisLysAspProAsnAlaIlePheLeuSerPheGln

HisLeuLeuArgGlyLysValArgPheLeuMetLeuValGlyGlySerThrLeuCysVal

ArgGluPheGlyGlyAsnGlyGlyAsnMetAlaSerProAlaProProAlaCysAspLeu

TABLE 3-continued

PROTEIN SEQUENCES

ArgValLeuSerLysLeuLeuArgAspSerHisValLeuHisSerArgLeuSerGlnCys
ProGluValHisProLeuProThrPro pMON28536
AlaAsnCysSerIleMetIleAspGluIleIleHisHisLeuLysArgProProAlaPro  (SEQ ID NO:230)
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnLeuProProGlnGly
ArgThrThrAlaHisLysAspProAsnAlaIlePheLeuSerPheGlnHisLeuLeuArg
GlyLysValArgPheLeuMetLeuValGlyGlySerThrLeuCysValArgGluPheGly
GlyAsnGlyGlyAsnMetAlaSerProAlaProProAlaCysAspLeuArgValLeuSer
LysLeuLeuArgAspSerHisValLeuHisSerArgLeuSerGlnCysProGluValHis
ProLeuProThrProValLeuLeuPro pMON28537
AlaAsnCysSerIleMetIleAspGluIleIleHisHisLeuLysArgProProAlaPro  (SEQ ID NO:231)
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspPheSerLeuGlyGluTrpLysThrGlnMetGluGluThr
LysAlaGlnAspIleLeuGlyAlaValThrLeuLeuLeuGluGlyValMetAlaAlaArg
GlyGlnLeuGlyProThrCysLeuSerSerLeuLeuGlyGlnLeuSerGlyGlnValArg
LeuLeuLeuGlyAlaLeuGlnSerLeuLeuGlyThrGlnLeuProProGlnGlyArgThr
ThrAlaHisLysAspProAsnAlaIlePheLeuSerPheGlnHisLeuLeuArgGlyLys
ValArgPheLeuMetLeuValGlyGlySerThrLeuCysValArgGluPheGlyGlyAsn
GlyGlyAsnMetAlaSerProAlaProProAlaCysAspLeuArgValLeuSerLysLeu
LeuArgAspSerHisValLeuHisSerArgLeuSerGlnCysProGluValHisProLeu
ProThrProValLeuLeuProAlaVal pMON28538
AlaAsnCysSerIleMetIleAspGluIleIleHisHisLeuLysArgProProAlaPro  (SEQ ID NO:232)
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly

TABLE 3-continued

PROTEIN SEQUENCES

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyGluTrpLysThrGlnMetGluGluThrLysAlaGlnAsp

IleLeuGlyAlaValThrLeuLeuGluGlyValMetAlaAlaArgGlyGlnLeuGly

ProThrCysLeuSerSerLeuLeuGlyGlnLeuSerGlyGlnValArgLeuLeuLeuGly

AlaLeuGlnSerLeuLeuGlyThrGlnLeuProProGlnGlyArgThrThrAlaHisLys

AspProAsnAlaIlePheLeuSerPheGlnHisLeuLeuArgGlyLysValArgPheLeu

MetLeuValGlyGlySerThrLeuCysValArgGluPheGlyGlyAsnGlyGlyAsnMet

AlaSerProAlaProProAlaCysAspLeuArgValLeuSerLysLeuLeuArgAspSer

HisValLeuHisSerArgLeuSerGlnCysProGluValHisProLeuProThrProVal

LeuLeuProAlaValAspPheSerLeu pMON28539
AlaAsnCysSerIleMetIleAspGluIleIleHisHisLeuLysArgProProAlaPro   (SEQ ID NO:233)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyProThrCysLeuSerSerLeuLeuGlyGlnLeuSerGly

GlnvajArgLeuLeuLeuGlyAlaLeuGlnSerLeuLeuGlyThrGlnLeuProProGln

GlyArgThrThrAlaHisLysAspProAsnAlaIlePheLeuSerPheGlnHisLeuLeu

ArgGlyLysValArgPheLeuMetLeuValGlyGlySerThrLeuCysValArgGluPhe

GlyGlyAsnGlyGlyAsnMetAlaSerProAlaProProAlaCysAspLeuArgValLeu

SerLysLeuLeuArgAspSerHisValLeuHisSerArgLeuSerGlnCysProGluVal

HisProLeuProThrProValLeuLeuProAlaValAspPheSerLeuGlyGluTrpLys

ThrGlnMetGluGluThrLysAlaGlnAspIleLeuGlyAlaValThrLeuLeuLeuGlu

GlyValMetAlaAlaArgGlyGlnLeu pMON28540
AlaAsnCysSerIleMetIleAspGluIleIleHisHisLeuLysArgProProAlaPro   (SEQ ID NO:234)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyThrGlnLeuProProGlnGlyArgThrThrAlaHisLys

AspProAsnAlaIlePheLeuSerPheGlnHisLeuLeuArgGlyLysValArgPheLeu

TABLE 3-continued

PROTEIN SEQUENCES

MetLeuValGlyGlySerThrLeuCysValArgGluPheGlyGlyAsnGlyGlyAsnMet

AlaSerProAlaProProAlaCysAspLeuArgValLeuSerLysLeuLeuArgAspSer

HisValLeuHisSerArgLeuSerGlnCysProGluValHisProLeuProThrProVal

LeuLeuProAlaValAspPheSerLeuGlyGluTrpLysThrGlnMetGluGluThrLys

AlaGlnAspIleLeuGlyAlaValThrLeuLeuLeuGluGlyValMetAlaAlaArgGly

GlnLeuGlyProThrCysLeuSerSerLeuLeuGlyGlnLeuSerGlyGlnValArgLeu

LeuLeuGlyAlaLeuGlnSerLeuLeu pMON28541

AlaAsnCysSerIleMetIleAspGluIleIleHisHisLeuLysArgProProAlaPro (SEQ ID NO:235)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProGysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetGlyArgThrThrAlaHisLysAspProAsnAlaIlePheLeu

SerPheGlnHisLeuLeuArgGlyLysValArgPheLeuMetLeuValGlyGlySerThr

LeuCysValArgGluPheGlyGlyAsnGlyGlyAsnMetAlaSerProAlaProProAla

CysAspLeuArgValLeuSerLysLeuLeuArgAspSerHisValLeuHisSerArgLeu

SerGlnCysProGluValHisProLeuProThrProValLeuLeuProAlaValAspPhe

SerLeuGlyGluTrpLysThrGlnMetGluGluThrLysAlaGlnAspIleLeuGlyAla

ValThrLeuLeuLeuGluGlyValMetAlaAlaArgGlyGlnLeuGlyProThrCysLeu

SerSerLeuLeuGlyGlnLeuSerGlyGlnValArgLeuLeuLeuGlyAlaLeuGlnSer

LeuLeuGlyThrGlnLeuProProGln pMON28542
AlaAsnCysSerIleMetIleAspGluIleIleHisHisLeuLysArgProProAlaPro (SEQ ID NO:236)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAlaHisLysAspProAsnAlaIlePheLeuSerPheGlnHis

LeuLeuArgGlyLysValArgPheLeuMetLeuValGlyGlySerThrLeuCysValArg

GluPheGlyGlyAsnGlyGlyAsnMetAlaSerProAlaProProAlaCysAspLeuArg

ValLeuSerLysLeuLeuArgAspSerHisValLeuHisSerArgLeuSerGlnCysPro

GluValHisProLeuProThrProValLeuLeuProAlaValAspPheSerLeuGlyGlu

TrpLysThrGlnMetGluGluThrLysAlaGlnAspIleLeuGlyAlaValThrLeuLeu

LeuGluGlyValMetAlaAlaArgGlyGlnLeuGlyProThrCysLeuSerSerLeuLeu

TABLE 3-continued

PROTEIN SEQUENCES

GlyGlnLeuSerGlyGlnValArgLeuLeuLeuGlyAlaLeuGlnSerLeuLeuGlyThr

GlnLeuProProGlnGlyArgThrThr pMON28543
AlaAsnCysSerIleMetIleAspGluIleIleHisHisLeuLysArgProProAlaPro  (SEQ ID NO:237)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAspProAsnAlaIlePheLeuSerPheGlnHisLeuLeuArg

GlyLysValArgPheLeuMetLeuValGlyGlySerThrLeuCysValArgGluPheGly

GlyAsnGlyGlyAsnMetAlaSerProAlaProPrdAlaCysAspLeuArgValLeuSer

LysLeuLeuArgAspSerHisValLeuHisSerArgLeuSerGlnCysProGluValHis

ProLeuProThrProValLeuLeuProAlaValAspPheSerLeuGlyGluTrpLysThr

GlnMetGluGluThrLysAlaGlnAspIleLeuGlyAlaValThrLeuLeuLeuGluGly

ValMetAlaAlaArgGlyGlnLeuGlyProThrCysLeuSerSerLeuLeuGlyGlnLeu

SerGlyGlnValArgLeuLeuLeuGlyAlaLeuGlnSerLeuLeuGlyThrGlnLeuPro

ProGlnGlyArgThrThrAlaHisLys pMON28544
AlaAsnCysSerIleMetIleAspGluIleIleHisHisLeuLysArgProProAlaPro  (SEQ ID NO:238)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAlaIlePheLeuSerPheGlnHisLeuLeuArgGlyLysVal

ArgPheLeuMetLeuValGlyGlySerThrLeuCysValArgGluPheGlyGlyAsnGly

GlyAsnMetAlaSerProAlaProProAlaCysAspLeuArgValLeuSerLysLeuLeu

ArgAspSerHisValLeuHisSerArgLeuSerGlnCysProGluValHisProLeuPro

ThrProValLeuLeuProAlaValAspPheSerLeuGlyGluTrpLysThrGlnMetGlu

GluThrLysAlaGlnAspIleLeuGlyAlaValThrLeuLeuLeuGluGlyValMetAla

AlaArgGlyGlnLeuGlyProThrCysLeuSerSerLeuLeuGlyGlnLeuSerGlyGln

ValArgLeuLeuLeuGlyAlaLeuGlnSerLeuLeuGlyThrGlnLeuProProGlnGly

ArgThrThrAlaHisLysAspProAsn pMON28545
AlaAsnCysSerIleMetIleAspGluIleIleHisHisLeuLysArgProProAlaPro  (SEQ ID NO:239)

LeuLeuAspProAsnAsnLeuAsnAspGluAspValSerIleLeuMetAspArgAsnLeu

ArgLeuProAsnLeuGluSerPheValArgAlaValLysAsnLeuGluAsnAlaSerGly

TABLE 3-continued

PROTEIN SEQUENCES

IleGluAlaIleLeuArgAsnLeuGlnProCysLeuProSerAlaThrAlaAlaProSer

ArgHisProIleIleIleLysAlaGlyAspTrpGlnGluPheArgGluLysLeuThrPhe

TyrLeuValThrLeuGluGlnAlaGlnGluGlnGlnTyrValGluGlyGlyGlyGlySer

ProGlyGluProSerGlyProIleSerThrIleAsnProSerProProSerLysGluSer

HisLysSerProAsnMetAspProAsnAlaIlePheLeuSerPheGlnHisLeuLeuArg

GlyLysValArgPheLeuMetLeuValGlyGlySerThrLeuCysValArgGluPheGly

GlyAsnMetAlaSerProAlaProProAlaCysAspLeuArgValLeuSerLysLeuLeu

ArgAspSerHisValLeuHisSerArgLeuSerGlnCysProGluValHisProLeuPro

ThrProValLeuLeuProAlaValAspPheSerLeuGlyGluTrpLysThrGlnMetGlu

GluThrLysAlaGlnAspIleLeuGlyAlaValThrLeuLeuLeuGluGlyValMetAla

AlaArgGlyGlnLeuGlyProThrCysLeuSerSerLeuLeuGlyGlnLeuSerGlyGln

ValArgLeuLeuLeuGlyAlaLeuGlnSerLeuLeuGlyThrGlnGlyArgThrThrAla

HisLys pMON32132
SerProAlaProProAlaCysAspLeuArgValLeuSerLysLeuLeuArgAspSerHis (SEQ ID NO:252)

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsnAlaIlePheLeuSerPheGlnHisLeuLeuArgGlyLysValArg

PheLeuMetLeuValGlyGlySerThrLeuCysValArg

PMON32133
SerProAlaProProAlaCysAspLeuArgValLeuSerLysLeuLeuArgAspSerHis (SEQ ID NO:253)

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnGlyArgThrThrAlaHisLysAspPro

AsnAlaIlePheLeuSerPheGlnHisLeuLeuArgGlyLysValArgPheLeuMetLeu

ValGlyGlySerThrLeuCysValArg

PMON32134
SerProAlaProProAlaCysAspLeuArgValLeuSerLysLeuLeuArgAspSerHis (SEQ ID NO:254)

ValLeuHisSerArgLeuSerGlnCysProGluValHisProLeuProThrProValLeu

LeuProAlaValAspPheSerLeuGlyGluTrpLysThrGlnMetGluGluThrLysAla

GlnAspIleLeuGlyAlaValThrLeuLeuLeuGluGlyValMetAlaAlaArgGlyGln

LeuGlyProThrCysLeuSerSerLeuLeuGlyGlnLeuSerGlyGlnValArgLeuLeu

LeuGlyAlaLeuGlnSerLeuLeuGlyThrGlnLeuProProGlnGlyArgThrThrAla

HisLysAspProAsnAlaIlePheLeuSerPheGlnHisLeuLeuArgGlyLysValArg

PheLeuMetLeuValGlyGlySerThrLeuCysValArg

TABLE 3-continued

PROTEIN SEQUENCES pmon16017.pep
```
  1 Met Ala Asn Cys Ser Ile Met Ile Asp Glu Ile Ile His His Leu    (SEQ ID NO:271)
 16 Lys Arg Pro Pro Ala Pro Leu Leu Asp Pro Asn Asn Leu Asn Asp
 31 Glu Asp Val Ser Ile Leu Met Asp Arg Asn Leu Arg Leu Pro Asn
 46 Leu Glu Ser Phe Val Arg Ala Val Lys Asn Leu Glu Asn Ala Ser
 61 Gly Ile Glu Ala Ile Leu Arg Asn Leu Gln Pro Cys Leu Pro Ser
 76 Ala Thr Ala Ala Pro Ser Arg His Pro Ile Ile Ile Lys Ala Gly
 91 Asp Trp Gln Glu Phe Arg Glu Lys Leu Thr Phe Tyr Leu Val Thr
106 Leu Glu Gln Ala Gln Glu Gln Gln Tyr Val Glu Gly Gly Gly Gly
121 Ser Pro Gly Glu Pro Ser Gly Pro Ile Ser Thr Ile Asn Pro Ser
136 Pro Pro Ser Lys Glu Ser His Lys Ser Pro Asn Met Ala Leu Gly
151 Pro Ala Ser Ser Leu Pro Gln Ser Phe Leu Leu Lys Ser Leu Glu
166 Gln Val Arg Lys Ile Gln Gly Asp Gly Ala Ala Leu Gln Glu Lys
181 Leu Cys Ala Thr Tyr Lys Leu Cys His Pro Glu Glu Leu Val Leu
196 Leu Gly His Ser Leu Gly Ile Pro Trp Ala Pro Leu Ser Ser Cys
211 Pro Ser Gln Ala Leu Gln Leu Ala Gly Cys Leu Ser Gln Leu His
226 Ser Gly Leu Phe Leu Tyr Gln Gly Leu Leu Gln Ala Leu Glu Gly
241 Ile Ser Pro Glu Leu Gly Pro Thr Leu Asp Thr Leu Gln Leu Asp
256 Val Ala Asp Phe Ala Thr Thr Ile Trp Gln Gln Met Glu Glu Leu
271 Gly Met Ala Pro Ala Leu Gln Pro Thr Gln Gly Ala Met Pro Ala
286 Phe Ala Ser Ala Phe Gln Arg Arg Ala Gly Gly Val Leu Val Ala
301 Ser His Leu Gln Ser Phe Leu Glu Val Ser Tyr Arg Val Leu Arg
316 His Leu Ala Gln Pro Asp Met Ala Thr Pro
``` pmon16018.pep
```
  1 Met Ala Asn Cys Ser Ile Met Ile Asp Glu Ile Ile His His Leu    (SEQ ID NO:272)
 16 Lys Arg Pro Pro Ala Pro Leu Leu Asp Pro Asn Asn Leu Asn Asp
 31 Glu Asp Val Ser Ile Leu Met Asp Arg Asn Leu Arg Leu Pro Asn
 46 Leu Glu Ser Phe Val Arg Ala Val Lys Asn Leu Glu Asn Ala Ser
 61 Gly Ile Glu Ala Ile Leu Arg Asn Leu Gln Pro Cys Leu Pro Ser
 76 Ala Thr Ala Ala Pro Ser Arg His Pro Ile Ile Ile Lys Ala Gly
 31 Asp Trp Gln Glu Phe Arg Glu Lys Leu Thr Phe Tyr Leu Val Thr
106 Leu Glu Gln Ala Gln Glu Gln Gln Tyr Val Glu Gly Gly Gly Gly
121 Ser Pro Gly Glu Pro Ser Gly Pro Ile Ser Thr Ile Asn Pro Ser
136 Pro Pro Ser Lys Glu Ser His Lys Ser Pro Asn Met Ala Leu Gly
151 Pro Ala Ser Ser Leu Pro Gln Ser Phe Leu Leu Lys Ser Leu Glu
176 Gln Val Arg Lys Ile Gln Gly Asp Gly Ala Ala Leu Gln Glu Lys
191 Leu Cys Ala Thr Tyr Lys Leu Cys His Pro Glu Glu Leu Val Leu
206 Leu Gly His Ser Leu Gly Ile Pro Trp Ala Pro Leu Ser Ser Cys
221 Pro Ser Gln Ala Leu Gln Leu Ala Gly Cys Leu Ser Gln Leu His
```

TABLE 3-continued

PROTEIN SEQUENCES

```
236  Ser Gly Leu Phe Leu Tyr Gln Gly Leu Leu Gln Ala Leu Glu Gly

251  Ile Ser Pro Glu Leu Gly Pro Thr Leu Asp Thr Leu Gln Leu Asp

266  Val Ala Asp Phe Ala Thr Thr Ile Trp Gln Gln Met Glu Glu Leu

281  Gly Met Ala Pro Ala Leu Gln Pro Thr Gln Gly Ala Met Pro Ala

296  Phe Ala Ser Ala Phe Gln Arg Arg Ala Gly Gly Val Leu Val Ala

311  Ser His Leu Gln Ser Phe Leu Glu Val Ser Tyr Arg Val Leu Arg

326  His Leu Ala Gln Pro Asp Met Ala Thr Pro
``` pmon16019.pep
```
  1  Met Ala Asn Cys Ser Ile Met Ile Asp Glu Ile Ile His His Leu    (SEQ ID NO:273)

16  Lys Arg Pro Pro Ala Pro Leu Leu Asp Pro Asn Asn Leu Asn Asp

31  Glu Asp Val Ser Ile Leu Met Asp Arg Asn Leu Arg Leu Pro Asn

46  Leu Glu Ser Phe Val Arg Ala Val Lys Asn Leu Glu Asn Ala Ser

61  Gly Ile Glu Ala Ile Leu Arg Asn Leu Gln Pro Cys Leu Pro Ser

76  Ala Thr Ala Ala Pro Ser Arg His Pro Ile Ile Ile Lys Ala Gly

91  Asp Trp Gln Glu Phe Arg Glu Lys Leu Thr Phe Tyr Leu Val Thr

106  Leu Glu Gln Ala Gln Glu Gln Gln Tyr Val Glu Gly Gly Gly Gly

121  Ser Pro Gly Glu Pro Ser Gly Pro Ile Ser Thr Ile Asn Pro Ser

136  Pro Pro Ser Lys Glu Ser His Lys Ser Pro Asn Met Ala Phe Leu

151  Leu Lys Ser Leu Glu Gln Val Arg Lys Ile Gln Gly Asp Gly Ala

166  Ala Leu Gln Glu Lys Leu Cys Ala Thr Tyr Lys Leu Cys His Pro

181  Glu Glu Leu Val Leu Leu Gly His Ser Leu Gly Ile Pro Trp Ala

196  Pro Leu Ser Ser Cys Pro Ser Gln Ala Leu Gln Leu Ala Gly Cys

211  Leu Ser Gln Leu His Ser Gly Leu Phe Leu Tyr Gln Gly Leu Leu

226  Gln Ala Leu Glu Gly Ile Ser Pro Glu Leu Gly Pro Thr Leu Asp

241  Thr Leu Gln Leu Asp Val Ala Asp Phe Ala Thr Thr Ile Trp Gln

256  Gln Met Glu Glu Leu Gly Met Ala Pro Ala Leu Gln Pro Thr Gln

271  Gly Ala Met Pro Ala Phe Ala Ser Ala Phe Gln Arg Arg Ala Gly

286  Gly Val Leu Val Ala Ser His Leu Gln Ser Phe Leu Glu Val Ser

301  Tyr Arg Val Leu Arg His Leu Ala Gln Pro Asp Met Ala Thr Pro

316  Leu Gly Pro Ala Ser Ser Leu Pro Gln Ser
``` pmon16020.pep
```
  1  Met Ala Asn Cys Ser Ile Met Ile Asp Glu Ile Ile His His Leu    (SEQ ID NO:274)

16  Lys Arg Pro Pro Ala Pro Leu Leu Asp Pro Asn Asn Leu Asn Asp

31  Glu Asp Val Ser Ile Leu Met Asp Arg Asn Leu Arg Leu Pro Asn

46  Leu Glu Ser Phe Val Arg Ala Val Lys Asn Leu Glu Asn Ala Ser

61  Gly Ile Glu Ala Ile Leu Arg Asn Leu Gln Pro Cys Leu Pro Ser

76  Ala Thr Ala Ala Pro Ser Arg His Pro Ile Ile Ile Lys Ala Gly

91  Asp Trp Gln Glu Phe Arg Glu Lys Leu Thr Phe Tyr Leu Val Thr

106  Leu Glu Gln Ala Gln Glu Gln Gln Tyr Val Glu Gly Gly Gly Gly

121  Ser Pro Gly Glu Pro Ser Gly Pro Ile Ser Thr Ile Asn Pro Ser
```

TABLE 3-continued

PROTEIN SEQUENCES

```
136  Pro Pro Ser Lys Glu Ser His Lys Ser Pro Asn Met Ala Glu Gln

151  Val Arg Lys Ile Gln Gly Asp Gly Ala Ala Leu Gln Glu Lys Leu

166  Cys Ala Thr Tyr Lys Leu Cys His Pro Glu Glu Leu Val Leu Leu

181  Gly His Ser Leu Gly Ile Pro Trp Ala Pro Leu Ser Ser Cys Pro

196  Ser Gln Ala Leu Gln Leu Ala Gly Cys Leu Ser Gln Leu His Ser

211  Gly Leu Phe Leu Tyr Gln Gly Leu Leu Gln Ala Leu Glu Gly Ile

226  Ser Pro Glu Leu Gly Pro Thr Leu Asp Thr Leu Gln Leu Asp Val

241  Ala Asp Phe Ala Thr Thr Ile Trp Gln Gln Met Glu Glu Leu Gly

256  Met Ala Pro Ala Leu Gln Pro Thr Gln Gly Ala Met Pro Ala Phe

271  Ala Ser Ala Phe Gln Arg Arg Ala Gly Gly Val Leu Val Ala Ser

286  His Leu Gln Ser Phe Leu Glu Val Ser Tyr Arg Val Leu Arg His

301  Leu Ala Gln Pro Asp Met Ala Thr Pro Leu Gly Pro Ala Ser Ser

316  Leu Pro Gln Ser Phe Leu Leu Lys Ser Leu
``` pmon16021.pep
```
  1  Met Ala Asn Cys Ser Ile Met Ile Asp Glu Ile Ile His His Leu     (SEQ ID NO:275)

16  Lys Arg Pro Pro Ala Pro Leu Leu Asp Pro Asn Asn Leu Asn Asp

31  Glu Asp Val Ser Ile Leu Met Asp Arg Asn Leu Arg Leu Pro Asn

46  Leu Glu Ser Phe Val Arg Ala Val Lys Asn Leu Glu Asn Ala Ser

61  Gly Ile Glu Ala Ile Leu Arg Asn Leu Gln Pro Cys Leu Pro Ser

76  Ala Thr Ala Ala Pro Ser Arg His Pro Ile Ile Ile Lys Ala Gly

91  Asp Trp Gln Glu Phe Arg Glu Lys Leu Thr Phe Tyr Leu Val Thr

106  Leu Glu Gln Ala Gln Glu Gln Gln Tyr Val Glu Gly Gly Gly Gly

121  Ser Pro Gly Glu Pro Ser Gly Pro Ile Ser Thr Ile Asn Pro Ser

136  Pro Pro Ser Lys Glu Ser His Lys Ser Pro Asn Met Ala Leu Leu

151  Gly His Ser Leu Gly Ile Pro Trp Ala Pro Leu Ser Ser Cys Pro

166  Ser Gln Ala Leu Gln Leu Ala Gly Cys Leu Ser Gln Leu His Ser

181  Gly Leu Phe Leu Tyr Gln Gly Leu Leu Gln Ala Leu Glu Gly Ile

196  Ser Pro Glu Leu Gly Pro Thr Leu Asp Thr Leu Gln Leu Asp Val

211  Ala Asp Phe Ala Thr Thr Ile Trp Gln Gln Met Glu Glu Leu Gly

226  Met Ala Pro Ala Leu Gln Pro Thr Gln Gly Ala Met Pro Ala Phe

241  Ala Ser Ala Phe Gln Arg Arg Ala Gly Gly Val Leu Val Ala Ser

256  His Leu Gln Ser Phe Leu Glu Val Ser Tyr Arg Val Leu Arg His

271  Leu Ala Gln Pro Asp Met Ala Thr Pro Leu Gly Pro Ala Ser Ser

286  Leu Pro Gln Ser Phe Leu Leu Lys Ser Leu Glu Gln Val Arg Lys

301  Ile Gln Gly Asp Gly Ala Ala Leu Gln Glu Lys Leu Cys Ala Thr

316  Tyr Lys Leu Cys His Pro Glu Glu Leu Val
``` pmon16022.pep
```
  1  Met Ala Asn Cys Ser Ile Met Ile Asp Glu Ile Ile His His Leu     (SEQ ID NO:276)

16  Lys Arg Pro Pro Ala Pro Leu Leu Asp Pro Asn Asn Leu Asn Asp
```

TABLE 3-continued

PROTEIN SEQUENCES

```
 31  Glu Asp Val Ser Ile Leu Met Asp Arg Asn Leu Arg Leu Pro Asn

46  Leu Glu Ser Phe Val Arg Ala Val Lys Asn Leu Glu Asn Ala Ser

61  Gly Ile Glu Ala Ile Leu Arg Asn Leu Gln Pro Cys Leu Pro Ser

76  Ala Thr Ala Ala Pro Ser Arg His Pro Ile Ile Ile Lys Ala Gly

91  Asp Trp Gln Glu Phe Arg Glu Lys Leu Thr Phe Tyr Leu Val Thr

106  Leu Glu Gln Ala Gln Glu Gln Gln Tyr Val Glu Gly Gly Gly Gly

121  Ser Pro Gly Glu Pro Ser Gly Pro Ile Ser Thr Ile Asn Pro Ser

136  Pro Pro Ser Lys Glu Ser His Lys Ser Pro Asn Met Ala Pro Leu

151  Ser Ser Cys Pro Ser Gln Ala Leu Gln Leu Ala Gly Cys Leu Ser

166  Gln Leu His Ser Gly Leu Phe Leu Tyr Gln Gly Leu Leu Gln Ala

181  Leu Glu Gly Ile Ser Pro Glu Leu Gly Pro Thr Leu Asp Thr Leu

196  Gln Leu Asp Val Ala Asp Phe Ala Thr Thr Ile Trp Gln Gln Met

211  Glu Glu Leu Gly Met Ala Pro Ala Leu Gln Pro Thr Gln Gly Ala

226  Met Pro Ala Phe Ala Ser Ala Phe Gln Arg Arg Ala Gly Gly Val

241  Leu Val Ala Ser His Leu Gln Ser Phe Leu Glu Val Ser Tyr Arg

256  Val Leu Arg His Leu Ala Gln Pro Asp Met Ala Thr Pro Leu Gly

271  Pro Ala Ser Ser Leu Pro Gln Ser Phe Leu Leu Lys Ser Leu Glu

286  Gln Val Arg Lys Ile Gln Gly Asp Gly Ala Ala Leu Gln Glu Lys

301  Leu Cys Ala Thr Tyr Lys Leu Cys His Pro Glu Glu Leu Val Leu

316  Leu Gly His Ser Leu Gly Ile Pro Trp Ala
``` pmon16023.pep

```
  1  Met Ala Asn Cys Ser Ile Met Ile Asp Glu Ile Ile His His Leu    (SEQ ID NO:277)

16  Lys Arg Pro Pro Ala Pro Leu Leu Asp Pro Asn Asn Leu Asn Asp

31  Glu Asp Val Ser Ile Leu Met Asp Arg Asn Leu Arg Leu Pro Asn

46  Leu Glu Ser Phe Val Arg Ala Val Lys Asn Leu Glu Asn Ala Ser

61  Gly Ile Glu Ala Ile Leu Arg Asn Leu Gln Pro Cys Leu Pro Ser

76  Ala Thr Ala Ala Pro Ser Arg His Pro Ile Ile Ile Lys Ala Gly

91  Asp Trp Gln Glu Phe Arg Glu Lys Leu Thr Phe Tyr Leu Val Thr

106  Leu Glu Gln Ala Gln Glu Gln Gln Tyr Val Glu Gly Gly Gly Gly

121  Ser Pro Gly Glu Pro Ser Gly Pro Ile Ser Thr Ile Asn Pro Ser

136  Pro Pro Ser Lys Glu Ser His Lys Ser Pro Asn Met Ala Gln Ala

151  Leu Gln Leu Ala Gly Cys Leu Ser Gln Leu His Ser Gly Leu Phe

166  Leu Tyr Gln Gly Leu Leu Gln Ala Leu Glu Gly Ile Ser Pro Glu

181  Leu Gly Pro Thr Leu Asp Thr Leu Gln Leu Asp Val Ala Asp Phe

196  Ala Thr Thr Ile Trp Gln Gln Met Glu Glu Leu Gly Met Ala Pro

211  Ala Leu Gln Pro Thr Gln Gly Ala Met Pro Ala Phe Ala Ser Ala

226  Phe Gln Arg Arg Ala Gly Gly Val Leu Val Ala Ser His Leu Gln

241  Ser Phe Leu Glu Val Ser Tyr Arg Val Leu Arg His Leu Ala Gln

256  Pro Asp Met Ala Thr Pro Leu Gly Pro Ala Ser Ser Leu Pro Gln
```

TABLE 3-continued

PROTEIN SEQUENCES

271 Ser Phe Leu Leu Lys Ser Leu Glu Gln Val Arg Lys Ile Gln Gly

286 Asp Gly Ala Ala Leu Gln Glu Lys Leu Cys Ala Thr Tyr Lys Leu

301 Cys His Pro Glu Glu Leu Val Leu Leu Gly His Ser Leu Gly Ile

316 Pro Trp Ala Pro Leu Ser Ser Cys Pro Ser pmon16024.pep
  1 Met Ala Asn Cys Ser Ile Met Ile Asp Glu Ile Ile His His Leu    (SEQ ID NO:278)

16 Lys Arg Pro Pro Ala Pro Leu Leu Asp Pro Asn Asn Leu Asn Asp

31 Glu Asp Val Ser Ile Leu Met Asp Arg Asn Leu Arg Leu Pro Asn

46 Leu Glu Ser Phe Val Arg Ala Val Lys Asn Leu Glu Asn Ala Ser

61 Gly Ile Glu Ala Ile Leu Arg Asn Leu Gln Pro Cys Leu Pro Ser

76 Ala Thr Ala Ala Pro Ser Arg His Pro Ile Ile Ile Lys Ala Gly

91 Asp Trp Gln Glu Phe Arg Glu Lys Leu Thr Phe Tyr Leu Val Thr

106 Leu Glu Gln Ala Gln Glu Gln Gln Tyr Val Glu Gly Gly Gly Gly

121 Ser Pro Gly Glu Pro Ser Gly Pro Ile Ser Thr Ile Asn Pro Ser

136 Pro Pro Ser Lys Glu Ser His Lys Ser Pro Asn Met Ala Leu Gln

151 Leu Ala Gly Cys Leu Ser Gln Leu His Ser Gly Leu Phe Leu Tyr

166 Gln Gly Leu Leu Gln Ala Leu Glu Gly Ile Ser Pro Glu Leu Gly

181 Pro Thr Leu Asp Thr Leu Gln Leu Asp Val Ala Asp Phe Ala Thr

196 Thr Ile Trp Gln Gln Met Glu Glu Leu Gly Met Ala Pro Ala Leu

211 Gln Pro Thr Gln Gly Ala Met Pro Ala Phe Ala Ser Ala Phe Gln

226 Arg Arg Ala Gly Gly Val Leu Val Ala Ser His Leu Gln Ser Phe

241 Leu Glu Val Ser Tyr Arg Val Leu Arg His Leu Ala Gln Pro Asp

256 Met Ala Thr Pro Leu Gly Pro Ala Ser Ser Leu Pro Gln Ser Phe

271 Leu Leu Lys Ser Leu Glu Gln Val Arg Lys Ile Gln Gly Asp Gly

286 Ala Ala Leu Gln Glu Lys Leu Cys Ala Thr Tyr Lys Leu Cys His

301 Pro Glu Glu Leu Val Leu Leu Gly His Ser Leu Gly Ile Pro Trp

316 Ala Pro Leu Ser Ser Cys Pro Ser Gln Ala pmon16025.pep
  1 Met Ala Asn Cys Ser Ile Met Ile Asp Glu Ile Ile His His Leu    (SEQ ID NO:279)

16 Lys Arg Pro Pro Ala Pro Leu Leu Asp Pro Asn Asn Leu Asn Asp

31 Glu Asp Val Ser Ile Leu Met Asp Arg Asn Leu Arg Leu Pro Asn

46 Leu Glu Ser Phe Val Arg Ala Val Lys Asn Leu Glu Asn Ala Ser

61 Gly Ile Glu Ala Ile Leu Arg Asn Leu Gln Pro Cys Leu Pro Ser

76 Ala Thr Ala Ala Pro Ser Arg His Pro Ile Ile Ile Lys Ala Gly

91 Asp Trp Gln Glu Phe Arg Glu Lys Leu Thr Phe Tyr Leu Val Thr

106 Leu Glu Gln Ala Gln Glu Gln Gln Tyr Val Glu Gly Gly Gly Gly

121 Ser Pro Gly Glu Pro Ser Gly Pro Ile Ser Thr Ile Asn Pro Ser

136 Pro Pro Ser Lys Glu Ser His Lys Ser Pro Asn Met Ala Leu Ala

151 Gly Cys Leu Ser Gln Leu His Ser Gly Leu Phe Leu Tyr Gln Gly

166 Leu Leu Gln Ala Leu Glu Gly Ile Ser Pro Glu Leu Gly Pro Thr

TABLE 3-continued

PROTEIN SEQUENCES

```
181  Leu Asp Thr Leu Gln Leu Asp Val Ala Asp Phe Ala Thr Thr Ile

196  Trp Gln Gln Met Glu Glu Leu Gly Met Ala Pro Ala Leu Gln Pro

211  Thr Gln Gly Ala Met Pro Ala Phe Ala Ser Ala Phe Gln Arg Arg

226  Ala Gly Gly Val Leu Val Ala Ser His Leu Gln Ser Phe Leu Glu

241  Val Ser Tyr Arg Val Leu Arg His Leu Ala Gln Pro Asp Met Ala

256  Thr Pro Leu Gly Pro Ala Ser Ser Leu Pro Gln Ser Phe Leu Leu

271  Lys Ser Leu Glu Gln Val Arg Lys Ile Gln Gly Asp Gly Ala Ala

286  Leu Gln Glu Lys Leu Cys Ala Thr Tyr Lys Leu Cys His Pro Glu

301  Glu Leu Val Leu Leu Gly His Ser Leu Gly Ile Pro Trp Ala Pro

316  Leu Ser Ser Cys Pro Ser Gln Ala Leu Gln
``` pmon16026.pep
```
  1  Met Ala Asn Cys Ser Ile Met Ile Asp Glu Ile Ile His His Leu    (SEQ ID NO:280)

16  Lys Arg Pro Pro Ala Pro Leu Leu Asp Pro Asn Asn Leu Asn Asp

31  Glu Asp Val Ser Ile Leu Met Asp Arg Asn Leu Arg Leu Pro Asn

46  Leu Glu Ser Phe Val Arg Ala Val Lys Asn Leu Glu Asn Ala Ser

61  Gly Ile Glu Ala Ile Leu Arg Asn Leu Gln Pro Cys Leu Pro Ser

76  Ala Thr Ala Ala Pro Ser Arg His Pro Ile Ile Ile Lys Ala Gly

91  Asp Trp Gln Glu Phe Arg Glu Lys Leu Thr Phe Tyr Leu Val Thr

106  Leu Glu Gln Ala Gln Glu Gln Gln Tyr Val Glu Gly Gly Gly Gly

121  Ser Pro Gly Glu Pro Ser Gly Pro Ile Ser Thr Ile Asn Pro Ser

136  Pro Pro Ser Lys Glu Ser His Lys Ser Pro Asn Met Ala Glu Leu

151  Gly Met Ala Pro Ala Leu Gln Pro Thr Gln Gly Ala Met Pro Ala

166  Phe Ala Ser Ala Phe Gln Arg Arg Ala Gly Gly Val Leu Val Ala

181  Ser His Leu Gln Ser Phe Leu Glu Val Ser Tyr Arg Val Leu Arg

196  His Leu Ala Gln Pro Asp Met Ala Thr Pro Leu Gly Pro Ala Ser

211  Ser Leu Pro Gln Ser Phe Leu Leu Lys Ser Leu Glu Gln Val Arg

226  Lys Ile Gln Gly Asp Gly Ala Ala Leu Gln Glu Lys Leu Cys Ala

241  Thr Tyr Lys Leu Cys His Pro Glu Glu Leu Val Leu Leu Gly His

256  Ser Leu Gly Ile Pro Trp Ala Pro Leu Ser Ser Cys Pro Ser Gln

271  Ala Leu Gln Leu Ala Gly Cys Leu Ser Gln Leu His Ser Gly Leu

286  Phe Leu Tyr Gln Gly Leu Leu Gln Ala Leu Glu Gly Ile Ser Pro

301  Glu Leu Gly Pro Thr Leu Asp Thr Leu Gln Leu Asp Val Ala Asp

316  Phe Ala Thr Thr Ile Trp Gln Gln Met Glu
``` pmon16027.pep
```
  1  Met Ala Asn Cys Ser Ile Met Ile Asp Glu Ile Ile His His Leu    (SEQ ID NO:281)

16  Lys Arg Pro Pro Ala Pro Leu Leu Asp Pro Asn Asn Leu Asn Asp

31  Glu Asp Val Ser Ile Leu Met Asp Arg Asn Leu Arg Leu Pro Asn

46  Leu Glu Ser Phe Val Arg Ala Val Lys Asn Leu Glu Asn Ala Ser

61  Gly Ile Glu Ala Ile Leu Arg Asn Leu Gln Pro Cys Leu Pro Ser
```

TABLE 3-continued

PROTEIN SEQUENCES

```
 76  Ala Thr Ala Ala Pro Ser Arg His Pro Ile Ile Ile Lys Ala Gly
 91  Asp Trp Gln Glu Phe Arg Glu Lys Leu Thr Phe Tyr Leu Val Thr
106  Leu Glu Gln Ala Gln Glu Gln Gln Tyr Val Gly Gly Gly Gly Gly
121  Ser Pro Gly Glu Pro Ser Gly Pro Ile Ser Thr Ile Asn Pro Ser
136  Pro Pro Ser Lys Glu Ser His Lys Ser Pro Asn Met Ala Gly Met
151  Ala Pro Ala Leu Gln Pro Thr Gln Gly Ala Met Pro Ala Phe Ala
166  Ser Ala Phe Gln Arg Arg Ala Gly Gly Val Leu Val Ala Ser His
181  Leu Gln Ser Phe Leu Glu Val Ser Tyr Arg Val Leu Arg His Leu
196  Ala Gln Pro Asp Met Ala Thr Pro Leu Gly Pro Ala Ser Ser Leu
211  Pro Gln Ser Phe Leu Leu Lys Ser Leu Glu Gln Val Arg Lys Ile
226  Gln Gly Asp Gly Ala Ala Leu Gln Glu Lys Leu Cys Ala Thr Tyr
241  Lys Leu Cys His Pro Glu Glu Leu Val Leu Leu Gly His Ser Leu
256  Gly Ile Pro Trp Ala Pro Leu Ser Ser Cys Pro Ser Gln Ala Leu
271  Gln Leu Ala Gly Cys Leu Ser Gln Leu His Ser Gly Leu Phe Leu
286  Tyr Gln Gly Leu Leu Gln Ala Leu Glu Gly Ile Ser Pro Glu Leu
301  Gly Pro Thr Leu Asp Thr Leu Gln Leu Asp Val Ala Asp Phe Ala
316  Thr Thr Ile Trp Gln Gln Met Glu Glu Leu
``` pmon16028.pep

```
  1  Met Ala Asn Cys Ser Ile Met Ile Asp Glu Ile Ile His His Leu    (SEQ ID NO:282)
 16  Lys Arg Pro Pro Ala Pro Leu Leu Asp Pro Asn Asn Leu Asn Asp
 31  Glu Asp Val Ser Ile Leu Met Asp Arg Asn Leu Arg Leu Pro Asn
 46  Leu Glu Ser Phe Val Arg Ala Val Lys Asn Leu Glu Asn Ala Ser
 61  Gly Ile Glu Ala Ile Leu Arg Asn Leu Gln Pro Cys Leu Pro Ser
 76  Ala Thr Ala Ala Pro Ser Arg His Pro Ile Ile Ile Lys Ala Gly
 91  Asp Trp Gln Glu Phe Arg Glu LyS Leu Thr Phe Tyr Leu Val Thr
106  Leu Glu Gln Ala Gln Glu Gln Gln Tyr Val Gly Gly Gly Gly Gly
121  Ser Pro Gly Glu Pro Ser Gly Pro Ile Ser Thr Ile Asn Pro Ser
136  Pro Pro Ser Lys Glu Ser His Lys Ser Pro Asn Met Ala Ser Phe
151  Leu Glu Val Ser Tyr Arg Val Leu Arg His Leu Ala Gln Pro Asp
166  Met Ala Thr Pro Leu Gly Pro Ala Ser Ser Leu Pro Gln Ser Phe
181  Leu Leu Lys Ser Leu Glu Gln Val Arg Lys Ile Gln Gly Asp Gly
196  Ala Ala Leu Gln Glu Lys Leu Cys Ala Thr Tyr Lys Leu Cys His
211  Pro Glu Glu Leu Val Leu Leu Gly His Ser Leu Gly Ile Pro Trp
226  Ala Pr6 Leu Ser Ser Cys Pro Ser Gln Ala Leu Gln Leu Ala Gly
241  Cys Leu Ser Gln Leu His Ser Gly Leu Phe Leu Tyr Gln Gly Leu
256  Leu Gln Ala Leu Glu Gly Ile Ser Pro Glu Leu Gly Pro Thr Leu
271  Asp Thr Leu Gln Leu Asp Val Ala Asp Phe Ala Thr Thr Ile Trp
286  Gln Gln Met Glu Glu Leu Gly Met Ala Pro Ala Leu Gln Pro Thr
301  Gln Gly Ala Met Pro Ala Phe Ala Ser Ala Phe Gln Arg Arg Ala
```

TABLE 3-continued

PROTEIN SEQUENCES

316 Gly Gly Val Leu Val Ala Ser His Leu Gln

MetAlaGlyArgThrThrAlaHisLysAspProAsnAlaIlePheLeuSerPheGlnHis  (SEQ ID NO:284)

LeuLeuArgGlyLysValArgPheLeuMetLeuValGlyGlySerThrLeuAlaValArg

GluPheGlyGlyAsnMetAlaSerProAlaProProAlaAlaAspLeuArgValLeuSer

LysLeuLeuArgAspSerHisValLeuHisSerArgLeuSerGlnCysProGluValHis

ProLeuProthrProValLeuLeuProAlaValAspPheSerLeuGlyGluTrpLysThr

GlnMetGluGluThrLysAlaGlnAspIleLeuGlyAlaValThrLeuLeuLeuGluGly

ValMetAlaAlaArgGlyGlnLeuGlyProThrCysLeuSerSerLeuLeuGlyGlnLeu

SerGlyGlnValArgLeuLeuLeuGlyAlaLeuGlnSerLeuLeuGlyThrGlnLeuPro

ProGln;

MetAlaGlyProThrCysLeuSerSerLeuLeuGlyGlnLeuSerGlyGlnValArgLeu  (SEQ ID NO:285)

LeuLeuGlyAlaLeuGlnSerLeuLeuGlyThrGlnLeuProProGlnGlyArgThrThr

AlaHisLysAspProAsnAlaIlePheLeuSerPheGlnHisLeuLeuArgGlyLysVal

ArgPheLeuMetLeuValGlyGlySerThrLeuAlaValArgGluPheGlyGlyAsnMet

AlaserproAlaProProAlaAlaAspleuArgValLeuSerLysLeuLeuArgAspSer

HisValLeuHisSerArgLeuSerGlnCysProGluValHisProLeuProThrProVal

LeuLeuProAlaValAspPheSerLeuGlyGluTrpLysThrGlnMetGluGluThrLys

AlaGlnAspIleLeuGlyAlaValThrLeuLeuLeuGluGlyValMetAlaAlaArgGly

GlnLeu

The following examples will illustrate the invention in greater detail although it will be understood that the invention is not limited to these specific examples.

HindIII site is 3' to the NcoI site and 5' to the poly-A sequence. The DNA sequence encoding the signal peptide is shown below (restriction enzyme sites are indicated above). The ATG (methionine) codon within the NcoI site is in-frame with the initiator ATG of the signal peptide (underlined);

```
                BamHI                                                          NcoI    (SEQ ID NO:255)
            5'GGATCCACCATGAGCCGCCTGCCCGTCCTGCTCCTGCTCCAACTCCTGGTCCGCCCCGCCATGG
```

EXAMPLE 1

Construction of Parental BHK Expression Vector
A. Removal of AflIII Site From Mammalian Expression Plasmid.

A new mammalian expression vector was constructed to accept NcoI-HindIII or AflIII-HindIII gene fragments in-frame and 3' to the hIL-3 receptor agonist pMON13146 (WO 94/12638) gene and a mouse IgG2b linker fragment. First, the single AflIII site was removed from pMON3934, which is a derivative of pMON3359. pMON3359 is a pUC18-based vector containing a mammalian expression cassette. The cassette includes a herpes simplex viral promoter IE110 (−800 to +120) followed by a modified human IL-3 signal peptide sequence and an SV40 late polyadenylation (poly-A) signal which has been subcloned into the pUC18 polylinker (See Hippenmeyer et al., Bio/Technology, 1993, pp.1037–1041). The modified human IL-3 signal sequence, which facilitates secretion of gene products outside of the cell, is flanked by a BamHI site on the 5' end and a unique NcoI site on the 3' end. A unique The single AflIII site was removed from pMON3934 by digestion with AflIII followed by filling in the overhangs by addition of a DNA polymerase and nucleotides. The digested DNA fragment was purified via Magic PCR Clean up kit (Promega) and ligated with T4 DNA ligase. The ligation reaction was transformed into DH5α™ and the cells were plated onto LB-agar plus ampicillin. Individual colonies were screened for the loss of the AflIII site by restriction analysis with AflIII and HindIII which results in a single fragment if the AflIII site was removed. The resulting plasmid was designated pMON30275.

B. Transfer of hIL-3 Receptor Agonist pMON13416/IgG2b Cassette Into pMON30275.

The NcoI-HindIII fragment (ca. 425 bp) from pMON30245 was ligated to the NcoI-HindIII fragment (ca. 3800 bp) of the pMON30275. pMON30245 (WO 94/12638) contains the gene coding for hIL-3 receptor agonist pMON13416 joined to a mouse IgG2b hinge fragment. Immediately 3' to the IgG2b hinge and 5' to the HindIII site is an AflIII site. Genes can be cloned into the AflIII-HindIII sites as NcoI-HindIII or AflIII-HindIII fragments in frame with the hIL-3 variant pMON13416/IgG2b hinge to create novel chimeras. The NcoI site and the AflIII site have compatible overhangs and will ligate but both recognition sites are lost. The plasmid, pMON30304 containing the DNA sequence of (SEQ ID NO:78), coding for hIL-3 variant pMON13416 joined with a mouse IgG2b hinge region, was a result of this cloning.

EXAMPLE 2

Construction of an Intermediate Plasmid Containing One Copy of the c-mpl Ligand (1–153) Gene of the Dimer Template In order to generate a plasmid DNA with the coding sequence of c-mpl (1–153) ligand followed by a unique EcoRI restriction site, the gene is isolated via reverse transcriptase/polymerase chain reaction (RT/PCR). Human fetal (lot #38130) and adult liver (lot #46018) A+ RNA are obtained from Clontech (Palo Alto, Calif.) for source of c-mpl ligand messenger RNA (mRNA). The first strand cDNA reactions are carried out using a cDNA Cycle™ Kit obtained from Invitrogen (San Diego, Calif.). In the RT reaction, random primers and oligo dT primer are used to generate cDNA from a combination of human and fetal liver mRNA. For amplification of c-mpl ligand gene fragment encoding amino acids 1–153, the RT product serves as the template for PCR with a combination of the primers, Forward primer: c-mplNcoI (SEQ ID NO:13) and Reverse primer: Ecompl. The c-mplNcoI primer anneals to the c-mpl ligand gene (bases #279–311 based on c-mpl ligand sequence from Gene bank accession #$L_{33410}$ or de Sauvage et al., Nature 369: 533–538 (1994)) and encodes a NcoI restriction enzyme site immediately 5' to the first codon (Ser+1) of c-mpl ligand. The NcoI restriction enzyme site codes for methionine and alanine codons prior to Ser'and includes codon degeneracy for the Ala codon and the first four codons (Ser, Pro, Ala, & Pro) of c-mpl ligand. The Ecompl primer anneals to bases #720–737 of c-mpl ligand and encodes an EcoRI site (GAATTC) in-frame with the c-mpl ligand gene immediately following Arg-153. The EcoRI site creates Glu and Phe codons following Arg-153. The ca. 480 bp PCR product was purified, digested with NcoI and EcoRI and ligated to the NcoI-EcoRI vector fragment of pMON3993 (ca. 4550 bp.). pMON3993 was a derivative of pMON3359 (described in Example 1). The human IL-3 signal peptide sequence, which had been subcloned as a BamHI fragment into the unique BamHI site between the IE110 promoter and poly-A signal, contains an NcoI site at its 3' end and is followed by a unique EcoRI site. The plasmid, pMON26458 containing the DNA sequence of (SEQ ID NO:79), coding for c-mpl ligand amino acids 1–153 (SEQ ID NO:161), was the result of this cloning.

EXAMPLE 3

Construction of the Parental Plasmids Containing the Second Genes of the Dimer Templates For amplification of c-mpl ligand gene fragments starting at amino acid 1 (Ser) with a termination codon following amino acid 153 (Arg), the RT reaction from Example 2 serves as the template for PCR with a combination of the following primers; c-mplNcoI (SEQ ID NO:13) (forward primer) and c-mplHindIII (SEQ ID NO:15) (reverse primer). The c-mplNcoI (SEQ ID NO:13) primer is described in Example 2. The c-mplHindIII (SEQ ID NO:15) primer, which anneals to bases #716–737 of c-mpl ligand, adds both a termination codon and a HindIII restriction enzyme site immediately following the final codon, $Arg^{153}$.

Two types of PCR products are generated from the RT cDNA samples, one with a deletion of the codons for amino acids 112–115 and one without the deletion of these codons. The c-mpl ligand PCR products (ca. 480 bp) are digested with NcoI and HindIII restriction enzymes for transfer to a mammalian expression vector, pMON3934. pMON3934 is digested with NcoI and HindIII (ca. 3800 bp) and will accept the PCR products.

Plasmid, pMON32132 (SEQ ID NO:249), coding for c-mpl ligand amino acids 1–153 (SEQ ID NO:252) was a result of this cloning. Plasmid, pMON32134 (SEQ ID NO:250), coding for c-mpl ligand amino acids 1–153 (SEQ ID NO:253) was a result of this cloning. Plasmid, pMON32133 (SEQ ID NO:251), coding for c-mpl ligand amino acids 1–153 with a deletion of codons 112–115 (Æ112–115) (SEQ ID NO:254) was also a result of this cloning.

EXAMPLE 4

Generation of PCR Dimer Template 5 L With a Æ112–115 Deletion in the Second c-mpl Ligand Gene A PCR template for generating novel forms of c-mpl ligand is constructed by ligating the 3.7 Kbp BstXI/EcoRI fragment of pMON26458 to the 1 Kbp NcoI/BstXI fragment from pMON32133 (containing a deletion of amino acids 112–115) along with the EcoRI/AflIII 5L synthetic oligonucleotide linker 5L-5' (SEQ ID NO:18) and 5L-3' (SEQ ID NO:19).

The EcoRI end of the linker will ligate to the EcoRI end of pMON26458. The AflIII end of the linker will ligate to the NcoI site of pMON32133, and neither restriction site will be retained upon ligation. The BstXI sites of pMON26458 and pMON32133 will ligate as well. Plasmid, pMON28548, is a result of the cloning and contains the DNA sequence of (SEQ ID NO:80) which encodes amino acids 1–153 c-mpl ligand fused via a GluPheGlyGlyAsnMetAla (SEQ ID NO:222) linker to amino acids 1–153 c-mpl ligand that contains a deletion of amino acids 112–115 (SEQ ID NO:162).

EXAMPLE 5

Generation of PCR Dimer Template 4L

A PCR template for generating novel forms of c-mpl ligand is constructed by ligating the 3.7 Kbp BstXI/EcoRI fragment of pMON26458 to the 1 Kbp NcoI/BstXI fragment from pMON32132 along with the EcoRI/AflIII 4L synthetic oligonucleotide linker 4L-5' (SEQ ID NO:16) and 4L-3' (SEQ ID NO:17).

The EcoRI end of the linker will ligate to the EcoRI end of pMON26458. The AflIII end of the linker will ligate to the NcoI site of pMON32132, and neither restriction site will be retained upon ligation. The BstXI sites of pMON26458 and pMON32132 will ligate as well. The plasmid, pMON28500, is a result of the cloning and contains the DNA sequence of (SEQ ID NO:82) which encodes amino acids 1–153 c-mpl ligand fused via a GluPheGlyAsnMetAla (SEQ ID NO:223) linker (4L) to amino acids 1–153 c-mpl ligand (SEQ ID NO:163).

EXAMPLE 6

Generation of PCR Dimer Template 5L

A PCR template for generating novel forms of c-mpl ligand is constructed by ligating the 3.7 Kbp BstXI/EcoRI fragment of pMON26458 to the 1 Kbp NcoI/BstXI fragment from pMON32132 along with the EcoRI/AflIII 5L synthetic oligonucleotide linker 5L-5' (SEQ ID NO:18) and 5L-3' (SEQ ID NO:19).

The EcoRI end of the linker will ligate to the EcoRI end of pMON26458. The AflIII end of the linker will ligate to the NcoI site of pMON32132, and neither restriction site will be retained upon ligation. The BstXI sites of pMON26458 and pMON32132 will ligate as well. Plasmid, pMON28501 is a result of the cloning and contains the DNA sequence of (SEQ ID NO: 82) which encodes amino acids 1–153 c-mpl ligand fused via a GluPheGlyGlyAsnMetAla (SEQ ID NO:222) linker (5L) to amino acids 1–153 c-mpl ligand (SEQ ID NO:164).

EXAMPLE 7

Generation of PCR Dimer Templates 8L

A PCR template for generating novel forms of c-mpl ligand is constructed by ligating the 3.7 Kbp BstXI/EcoRI fragment of pMON26458 to the 1 Kbp NcoI/BstXI fragment from pMON32134 along with the EcoRI/AflIII 8L synthetic oligonucleotide linker 8L-5' (SEQ ID NO:20) and 8L-3' (SEQ ID NO:21).

The EcoRI end of the linker will ligate to the EcoRI end of pMON26458. The AflIII end of the linker will ligate to the NcoI site of pMON32134, and neither restriction site will be retained upon ligation. The BstXI sites of pMON26458 and pMON32134 will ligate as well. Plasmid, pMON28502 is a result of the cloning which contains the DNA sequence of (SEQ ID NO:83) and encodes amino acids 1–153 c-mpl ligand fused via a GluPheGlyGlyAsnGlyGlyAsnMetAla (SEQ ID NO:224) linker (8L) to amino acids 1–153 c-mpl ligand (SEQ ID NO:165).

EXAMPLES 8–44

Generation of Novel c-mpl Ligand Genes With New N-Terminus and C-Terminus

A. PCR Generation of Genes Encoding Novel c-mpl Ligand Receptor Agonists.

Genes encoding novel c-mpl ligand receptor agonists were generated using Method III (Horlick et al., *Prot. Eng.* 5:427–433, 1992). The PCR reactions were carried out using dimer templates, pMONs 28500, 28501, 28502 or 28548 and one of the sets of synthetic primer sets below (The first number refers to the position of the first amino acid in the original sequence. For example, the 31-5' and 31-3' refers to the 5' and 3' oligo primers, receptively, for the sequence beginning at the codon corresponding to residue 31 of the original sequence.).

31-5' (SEQ ID NO:22) and 31-3' (SEQ ID NO:23), 35-5' (SEQ ID NO:24) and 35-3' (SEQ ID NO:25), 39-5' (SEQ ID NO:26) and 39-3' (SEQ ID NO:27), 43-5' (SEQ ID NO:28) and 43-3' (SEQ ID NO:29), 45-5' (SEQ ID NO:30) and 45-3' (SEQ ID NO:31), 49-5' (SEQ ID NO:32) and 49-3' (SEQ ID NO:33), 82-5' (SEQ ID NO:34) and 82-3' (SEQ ID NO:35), 109-5' (SEQ ID NO:36) and 109-3' (SEQ ID NO:37), 115-5' (SEQ ID NO:38) and 115-3' (SEQ ID NO:39), 120-5' (SEQ ID NO:40) and 120-3' (SEQ ID NO:41), 123-5' (SEQ ID NO:42) and 123-3' (SEQ ID NO:43), 126-5' (SEQ ID NO:44) and 126-3' (SEQ ID NO:45).

The templates and oligonucleotide sets used in the PCR reactions are shown in Table 4. The products that were generated were about 480 bp and were purified via Magic PCR Clean up kits (Promega).

B. Subcloning of Novel c-mpl Receptor Agonist Gene Products Into Mammalian Expression Vector for Generation of Chimeras.

The c-mpl receptor agonist gene PCR products were digested with NcoI and HindIII or AflIII and HindIII restriction enzymes (ca. 470 bp) for transfer to a mammalian expression vector. The expression vector, pMON30304, was digested with NcoI and HindIII (ca. 4200 bp) and accepts the PCR products as NcoI-HindIII or AflIII-HindIII fragments. The restriction digest of the PCR product and the resulting plasmids are shown in Table 4.

TABLE 4

| Example # | PCR template | PCR Product Primer set | PCR Product Restriction Digest | Linker | Resulting Plasmid pMON | Breakpoint in c-mpl ligand |
|---|---|---|---|---|---|---|
| Example 8 | pMON28501 | 31 | NcoI/HindIII | 5L | 28505 | 30–31 |
| Example 9 | pMON28501 | 35 | AflIII/HindIII | 5L | 28506 | 34–35 |
| Example 10 | pMON28501 | 39 | NcoI/HindIII | 5L | 28507 | 38–39 |
| Example 11 | pMON28501 | 43 | NcoI/HindIII | 5L | 28508 | 42–43 |
| Example 12 | pMON28501 | 45 | NcoI/HindIII | 5L | 28509 | 44–45 |
| Example 13 | pMON28501 | 49 | NcoI/HindIII | 5L | 28510 | 48–49 |
| Example 14 | pMON28501 | 82 | NcoI/HindIII | 5L | 28511 | 81–82 |
| Example 15 | pMON28501 | 109 | NcoI/HindIII | 5L | 28512 | 108–109 |
| Example 16 | pMON28501 | 116 | NcoI/HindIII | 5L | 28513 | 115–116 |
| Example 17 | pMON28501 | 120 | NcoI/HindIII | 5L | 28514 | 119–120 |
| Example 18 | pMON28501 | 123 | NcoI/HindIII | 5L | 28515 | 122–123 |
| Example 19 | pMON28501 | 126 | NcoI/HindIII | 5L | 28516 | 125–126 |
| Example 20 | pMON28500 | 31 | NcoI/HindIII | 4L | 28519 | 30–31 |
| Example 21 | pMON28500 | 35 | AflIII/HindIII | 4L | 28520 | 34–35 |
| Example 22 | pMON28500 | 39 | NcoI/HindIII | 4L | 28521 | 38–39 |
| Example 23 | pMON28500 | 43 | NcoI/HindIII | 4L | 28522 | 42–43 |
| Example 24 | pMON28500 | 45 | NcoI/HindIII | 4L | 28523 | 44–45 |
| Example 25 | pMON28500 | 49 | NcoI/HindIII | 4L | 28524 | 48–49 |
| Example 26 | pMON28500 | 82 | NcoI/HindIII | 4L | 28525 | 81–82 |
| Example 27 | pMON28500 | 109 | NcoI/HindIII | 4L | 28526 | 108–109 |
| Example 28 | pMON28500 | 116 | NcoI/HindIII | 4L | 28527 | 115–116 |
| Example 29 | pMON28500 | 120 | NcoI/HindIII | 4L | 28528 | 119–120 |

TABLE 4-continued

| Example # | PCR template | PCR Product Primer set | PCR Product Restriction Digest | Linker | Resulting Plasmid pMON | Breakpoint in c-mpl ligand |
|---|---|---|---|---|---|---|
| Example 30 | pMON28500 | 123 | NcoI/HindIII | 4L | 28529 | 122–123 |
| Example 31 | pMON28500 | 126 | NcoI/HindIII | 4L | 28530 | 125–126 |
| Example 32 | pMON28502 | 31 | NcoI/HindIII | 8L | 28533 | 30–31 |
| Example 33 | pMON28502 | 35 | AflIII/HindIII | 8L | 28534 | 34–35 |
| Example 34 | pMON28502 | 39 | NcoI/HindIII | 8L | 28535 | 38–39 |
| Example 35 | pMON28502 | 43 | NcoI/HindIII | 8L | 28536 | 42–43 |
| Example 36 | pMON28502 | 45 | NcoI/HindIII | 8L | 28537 | 44–45 |
| Example 37 | pMON28502 | 49 | NcoI/HindIII | 8L | 28538 | 48–49 |
| Example 38 | pMON28502 | 82 | NcoI/HindIII | 8L | 28539 | 81–82 |
| Example 39 | pMON28502 | 109 | NcoI/HindIII | 8L | 28540 | 108–109 |
| Example 40 | pMON28502 | 116 | NcoI/HindIII | 8L | 28541 | 115–116 |
| Example 41 | pMON28502 | 120 | NcoI/HindIII | 8L | 28542 | 119–120 |
| Example 42 | pMON28502 | 123 | NcoI/HindIII | 8L | 28543 | 122–123 |
| Example 43 | pMON28502 | 126 | NcoI/HindIII | 8L | 28544 | 125–126 |
| Example 44 | pMON28548 | 123 | NcoI/HindIII | 5L | 28545 | 122–123 |

EXAMPLE 45

Construction of MON15960

Construction of pMON15960, an intermediate plasmid used for constructing plasmids containing DNA sequences encoding G-CSF Ser$^{17}$ with a new N-terminus and C-terminus. Plasmid pACYC$_{177}$ (Chang, A.C.Y. and Cohen, S. N. *J. Bacteriol.* 134:1141–1156, 1978) DNA was digested with restriction enzymes HindIII and BamHI, resulting in a 3092 base pair HindIII, BamHI fragment. Plasmid, pMON13037 (WO 95/21254), DNA was digested with BglII and FspI, resulting in a 616 base pair BglII, FspI fragment. A second sample of plasmid, pMON13037, DNA was digested with NcoI and HindIII, resulting in a 556 base pair NcoI, HindIII fragment. The synthetic DNA oligonucleotides 1GGGSfor (SEQ ID NO:76) and lGGGSrev (SEQ ID NO:77) were annealed to each other, and then digested with AflIII and FspI, resulting in a 21 base pair AflIII, FspI fragment. The restriction fragments were ligated, and the ligation reaction mixture was used to transform *E. coli* K-12 strain JM101. Transformant bacteria were selected on ampicillin-containing plates. Plasmid DNA was isolated and analyzed by restriction analysis to confirm the correct insert.

EXAMPLE 46

Construction of pMON15981

Construction of pMON15981, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 38 stop (SEQ ID NO:65) and 39 start (SEQ ID NO:64) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform *E. coli* K-12 strain JM101. Transformant bacteria were selected on ampicillin-containing plates. Plasmid DNA was isolated, analyzed by restriction analysis, and sequenced to confirm the correct insert. The plasmid, pMON15981, contains the DNA sequence of (SEQ ID NO:155) which encodes the following amino acid sequence:

```
MetAlaAsnCysSerIleMetIleAspGluIleIleHisHisLeuLysArgProProAla    (SEQ ID NO:195)

ProLeuLeuAspProAsnAsnLeuAsnAspGluAspValSerIleLeuMetAspArgAsn

LeuArgLeuProAsnLeuGluSerPheValArgAlaValLysAsnLeuGluAsnAlaSer

GlyIleGluAlaIleLeuArgAsnLeuGlnProCysLeuProSerAlaThrAlaAlaPro

SerArgHisProIleIleIleLysAlaGlyAspTrpGlnGluPheArgGluLysLeuThr

PheTyrLeuValThrLeuGluGlnAlaGlnGluGlnTyrValGluGlyGlyGlyGly

SerProGlyGluProSerGlyProIleSerThrIleAsnProSerProProSerLysGlu

SerHisLysSerProAsnMetAlaTyrLysLeuCysHisProGluGluLeuValLeuLeu

GlyHisSerLeuGlyIleProTrpAlaProLeuSerSerCysProSerGlnAlaLeuGln

LeuAlaGlyCysLeuSerGlnLeuHisSerGlyLeuPheLeuTyrGlnGlyLeuLeuGln

AlaLeuGluGlyIleSerProGluLeuGlyProThrLeuAspThrLeuGlnLeuAspVal

AlaAspPheAlaThrThrIleTrpGlnGlnMetGluGluLeuGlyMetAlaProAlaLeu
```

-continued
```
GlnProThrGlnGlyAlaMetProAlaPheAlaSerAlaPheGlnArgArgAlaGlyGly

ValLeuValAlaSerHisLeuGlnSerPheLeuGluValSerTyrArgValLeuArgHis

LeuAlaGlnProGlyGlyGlySerAspMetAlaThrProLeuGlyProAlaSerSerLeu

ProGlnSerPheLeuLeuLysSerLeuGluGlnValArgLysIleGlnGlyAspGlyAla

AlaLeuGlnGluLysLeuCysAlaThr
```

EXAMPLE 47

Construction of pMON15982

Construction of pMON15982, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 96 stop (SEQ ID NO:67) and 97 start (SEQ ID NO:66) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform *E. coli* K-12 strain JM101. Transformant bacteria were selected on ampicillin-containing plates. Plasmid DNA was isolated, analyzed by restriction analysis, and sequenced to confirm the correct insert. The plasmid, pMON15982, contains the DNA sequence of (SEQ ID NO:157) which encodes the following amino acid sequence:

EXAMPLE 48

Construction of pMON15965

Construction of pMON15965, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 142 stop (SEQ ID NO:73) and 141 start (SEQ ID NO:72) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform *E. coli* K-12 strain JM101. Transformant bacteria were. selected on ampicillin-containing plates. Plasmid DNA was isolated, analyzed by restriction analysis, and sequenced to confirm the correct insert. The plasmid, pMON15965, contains the DNA sequence of (SEQ ID NO:157) which encodes the following amino acid sequence:

MetAlaAsnCysSerIleMetIleAspGluIleIleHisHisLeuLysArgProProAla (SEQ ID NO:196)

ProLeuLeuAspProAsnAsnLeuAsnAspGluAspValSerIleLeuMetAspArgAsn

LeuArgLeuProAsnLeuGluSerPheValArgAlaValLysAsnLeuGluAsnAlaSer

GlyIleGluAlaIleLeuArgAsnLeuGlnProCysLeuProSerAlaThrAlaAlaPro

SerArgHisProIleIleIleLysAlaGlyAspTrpGlnGluPheArgGluLysLeuThr

PheTyrLeuValThrLeuGluGlnAlaGlnGluGlnGlnTyrValGluGlyGlyGlyGly

SerProGlyGluProSerGlyProIleSerThrIleAsnProSerProProSerLysGlu

SerHisLysSerProAsnMetAlaProGluLeuGlyProThrLeuAspThrLeuGlnLeu

AspValAlaAspPheAlaThrThrIleTrpGlnGlnMetGluGluLeuGlyMetAlaPro

AlaLeuGlnProThrGlnGlyAlaMetProAlaPheAlaSerAlaPheGlnArgArgAla

GlyGlyValLeuValAlaSerHisLeuGlnSerPheLeuGluValSerTyrArgValLeu

ArgHisLeuAlaGlnProGlyGlyGlySerAspMetAlaThrProLeuGlyProAlaSer

SerLeuProGlnSerPheLeuLeuLysSerLeuGluGlnValArgLysIleGlnGlyAsp

GlyAlaAlaLeuGlnGluLysLeuCysAlaThrTyrLysLeuCysHisProGluGluLeu

ValLeuLeuGlyHisSerLeuGlyIleProTrpAlaProLeuSerSerCysProSerGln

AlaLeuGlnLeuAlaGlyCysLeuSerGlnLeuHisSerGlyLeuPheLeuTyrGlnGly

LeuLeuGlnAlaLeuGluGlyIleSer

MetAlaAsnCysSerIleMetIleAspGluIleIleHisHisLeuLysArgProProAla (SEQ ID NO:196)

ProLeuLeuAspProAsnAsnLeuAsnAspGluAspValSerIleLeuMetAspArgAsn

LeuArgLeuProAsnLeuGluSerPheValArgAlaValLysAsnLeuGluAsnAlaSer

GlyIleGluAlaIleLeuArgAsnLeuGlnProCysLeuProSerAlaThrAlaAlaPro

SerArgHisProIleIleIleLysAlaGlyAspTrpGlnGluPheArgGluLysLeuThr

PheTyrLeuValThrLeuGluGlnklaGlnGluGlnGlnTyrValGluGlyGlyGlyGly

SerProGlyGluProSerGlyProIleSerThrIleAsnProSerProProSerLysGlu

SerHisLysSerProAsnMetAlaSerAlaPheGlnArgArgAlaGlyGlyValLeuVal

AlaSerHisLeuGlnSerPheLeuGluValSerTyrArgValLeuArgHisLeuAlaGln

ProGlyGlyGlySerAspMetAlaThrProLeuGlyProAlaSerSerLeuProGlnSer

PheLeuLeuLysSerLeuGluGlnValArgLysIleGlnGlyAspGlyAlaAlaLeuGln

GluLysLeuCysAlaThrTyrLysLeuCysHisProGluGluLeuValLeuLeuGlyHis

SerLeuGlyIleProTrpAlaProLeuSerSerCysProSerGlnAlaLeuGlnLeuAla

GlyCysLeuSerGlnLeuHisSerGlyLeuPheLeuTyrGlnGlyLeuLeuGlnAlaLeu

GluGlyIleSerProGluLeuGlyProThrLeuAspThrLeuGlnLeuAspValAlaAsp

PheAlaThrThrIleTrpGlnGlnMetGluGluLeuGlyMetAlaProAlaLeuGlnPro

ThrGlnGlyAlaMetProAlaPheAla

EXAMPLE 49

Construction of pMON15966

Construction of pMON15966, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 126 stop (SEQ ID NO:68) and 125 start (SEQ ID NO:69) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform *E. coli* K-12 strain JM101. Transformant bacteria were selected on ampicillin-containing plates. Plasmid DNA was isolated, analyzed by restriction analysis, and sequenced to confirm the correct insert. The plasmid, pMON15966, contains the DNA sequence of (SEQ ID NO:158) which encodes the following amino acid sequence:

MetAlaAsnCysSerIleMetIleAspGluIleIleHisHisLeuLysArgProProAla (SEQ ID NO:198)

ProLeuLeuAspProAsnAsnLeuAsnAspGluAspValSerIleLeuMetAspArgAsn

LeuArgLeuProAsnLeuGluSerPheValArgAlaValLysAsnLeuGluAsnAlaSer

GlyIleGluAlaIleLeuArgAsnLeuGlnProCysLeuProSerAlaThrAlaAlaPro

SerArgHisProIleIleIleLysAlaGlyAspTrpGlnGluPheArgGluLysLeuThr

PheTyrLeuValThrLeuGluGlnAlaGlnGluGlnGlnTyrValGluGlyGlyGlyGly

SerProGlyGluProSerGlyProIleSerThrIleAsnProSerProProSerLysGlu

SerHisLysSerProAsnMetAlaMetAlaProAlaLeuGlnProThrGlnGlyAlaMet

ProAlaPheAlaSerAlaPheGlnArgArgAlaGlyGlyValLeuValAlaSerHisLeu

GlnSerPheLeuGluValSerTyrArgValLeuArgHisLeuAlaGlnProGlyGlyGly

SerAspMetAlaThrProLeuGlyProAlaSerSerLeuProGlnSerPheLeuLeuLys

SerLeuGluGlnValArgLysIleGlnGlyAspGlyAlaAlaLeuGlnGluLysLeuCys

AlaThrTyrLysLeuCysHisProGluGluLeuValLeuLeuGlyHisSerLeuGlyIle

ProTrpAlaProLeuSerSerCysProSerGlnAlaLeuGlnLeuAlaGlyCysLeuSer

-continued

```
GlnLeuHisSerGlyLeuPheLeuTyrGlnGlyLeuLeuGlnAlaLeuGluGlyIleSer

ProGluLeuGlyProThrLeuAspThrLeuGlnLeuAspValAlaAspPheAlaThrThr

IleTrpGlnGlnMetGluGluLeuGly
```

EXAMPLE 50

Construction of pMON15967

Construction of pMON15967, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 132 stop (SEQ ID NO:71) and 133 start (SEQ ID NO:70) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform *E. coli* K-12 strain JM101. Transformant bacteria were selected on ampicillin-containing plates. Plasmid DNA was isolated, analyzed by restriction analysis, and sequenced to confirm the correct insert. The plasmid, pMON15967, contains the DNA sequence of (SEQ ID NO: 159) which encodes the following amino acid sequence:

MetAlaAsnCysSerIleMetIleAspGluIleIleHisHisLeuLysArgProProAla

ProLeuLeuAspProAsnAsnLeuAsnAspGluAspValSerIleLeuMetAspArgAsn

LeuArgLeuProAsnLeuGluSerPheValArgAlaValLysAsnLeuGluAsnAlaSer

GlyIleGluAlaIleLeuArgAsnLeuGlnProCysLeuProSerAlaThrAlaAlaPro

SerArgHisProIleIleIleLysAlaGlyAspTrpGlnGluPheArgGluLysLeuThr

PheTyrLeuValThrLeuGluGlnAlaGlnGluGlnGlnTyrValGluGlyGlyGlyGly

SerProGlyGluProSerGlyProIleSerThrIleAsnProSerProProSerLysGlu

SerHisLysSerProAsnMetAlaThrGlnGlyAlaMetProAlaPheAlaSerAlaPhe

GlnArgArgAlaGlyGlyValLeuValAlaSerHisLeuGlnSerPheLeuGluValSer

TyrArgValLeuArgHisLeuAlaGlnProGlyGlyGlySerAspMetAlaThrProLeu

GlyProAlaSerSerLeuProGlnSerPheLeuLeuLysSerLeuGluGlnValArgLys

IleGlnGlyAspGlyAlaAlaLeuGlnGluLysLeuCysAlaThrTyrLysLeuCysHis

ProGluGluLeuValLeuLeuGlyHisSerLeuGlyIleProTrpAlaProLeuSerSer

CysProSerGlnAlaLeuGlnLeuAlaGlyCysLeuSerGlnLeuHisSerGlyLeuPhe

LeuTyrGlnGlyLeuLeuGlnAlaLeuGluGlyIleSerProGluLeuGlyProThrLeu

AspThrLeuGlnLeuAspValAlaAspPheAlaThrThrIleTrpGlnGlnMetGluGlu

LeuGlyMetAlaProAlaLeuGlnPro

EXAMPLE 51

Construction of pMON13180, an Intermediate Plasmid Used for Constructing Plasmids That Contain DNA Sequence Encoding Multi-functional Hematodoietic Receptor Agonists Plasmid, pMON13046 (WO 95/21254), DNA was digested with restriction endonucleases XmaI and SnaBI, resulting in a 4018 base pair vector fragment. The 4018 base pair XmaI-SnaBI fragment was purified using a Magic DNA Clean-up System kit (Promega, Madison, Wis.) in which the 25 base pair XmaI-SnaBI insert fragment is not retained. The complimentary pair of synthetic oligonucleotides, glyxal (SEQ ID NO:74) and glyxa2 (SEQ ID NO:75), were designed to remove sequence encoding a factor Xa cleavage site. When properly assembled these oligonucleotides also result in XmaI and SnaBI ends. The primers, Glyxa1 and glyxa2, were annealed in annealing buffer (20 mM Tris-HCl pH7.5, 10 mM $MgCl_2$, 50 mM NaCl) by heating at 70° C. for ten minutes and allowed to slow cool. The 4018 base pair XmaI-SnaBI fragment from pMON13046 was ligated with the assembled oligonucleotides using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated from the transformants and analyzed using a PCR based assay. Plasmid DNA from selected transformants was sequenced to confirm the correct insertion of the oligonucleotides. The resulting plasmid was designated pMON13180 and contains the DNA sequence of (SEQ ID NO:258).

EXAMPLE 52

Construction of pMON13181, an Intermediate Plasmid Used for Constructing Plasmids That Contain DNA Sequences Encoding Multi-functional Hematopoietic Receptor Agonists Plasmid, pMON13047 (WO 95/21254), DNA was digested with restriction endonucleases XmaI and SnaBI, resulting in a 4063 base pair vector fragment. The 4063 base pair XmaI-SnaBI fragment was purified using a Magic DNA Clean-up System kit (Promega, Madison, Wis.) in which the 25 base pair XmaI-SnaBI insert fragment is not retained. The complimentary pair of synthetic oligonucleotides, glyxa1 (SEQ ID NO:74) and glyxa2 (SEQ ID NO:75), were designed to remove sequence encoding the factor Xa cleavage site. When properly assembled these oligonucleotides also result in XmaI and SnaBI ends. Glyxa1 and glyxa2 were annealed in annealing buffer by heating at 70° C. for ten minutes and allowed to slow cool. The 4063 base pair XmaI-SnaBI fragment from pMON13047 was ligated with the assembled oligonucleotides using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated from the transformants and analyzed using a PCR based assay. Plasmid DNA from selected transformants was sequenced to confirm the correct insertion of the oligonucleotides. The resulting plasmid was designated pMON13181 and contains the DNA sequence of (SEQ ID NO:257).

EXAMPLE 53

Construction of pMON13182

The new N-terminus/C-terminus gene in pMON13182 was created using Method I as described in Materials and Methods. Fragment Start was created and amplified from G-CSF $Ser^{17}$ sequence in pMON13037 using the primer set, 39 start (SEQ ID NO:64) and L-11 start (SEQ ID NO:60). Fragment Stop was created and amplified from G-CSF $Ser^{17}$ sequence in pMON13037 using the primer set, 38 stop (SEQ ID NO:65) and L-11 stop (SEQ ID NO:61). The full-length new N terminus/C-terminus G-CSF $Ser^{17}$ gene was created and amplified from the annealed Fragments Start and Stop using primers 39 start and 38 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13182.

*E. coli* strain JM101 was transformed with pMON13182 for protein expression and protein isolation from inclusion bodies.

The plasmid, pMON13182, contains the DNA sequence of (SEQ ID NO:94) which encodes the following amino acid sequence:

```
Asn Cys Ser Ile Met Ile Asp Glu Ile Ile His His Leu Lys Arg (SEQ ID NO:166)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu
```

-continued

```
Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr
```

EXAMPLE 54

Construction of pMON13183

The new N-terminus/C-terminus gene in pMON13183 was created using Method I as described in Materials and Methods. "Fragment Start" was created and amplified from G-CSF Ser[17] sequence in pMON13037 using the primer set, 39 start (SEQ ID NO:64) and L-11 start (SEQ ID NO:60). Fragment Stop was created and amplified from G-CSF Ser[17] sequence in pMON13037 using the primer set, 38 stop (SEQ ID NO:65) and L-11 stop (SEQ ID NO:61). The full-length new N terminus/C-terminus G-CSF Ser[17] gene was created and amplified from the annealed Fragments Start and Stop using 39 start and 38 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5A cells (Life Technologies, Gaithersburg, Md.). Transformant bacteria were selected on ampicillin-containing plates. Plasmid DNA was isolated and sequenced to confirm the correct insert. The resulting plasmid was designated pMON13183.

*E. coli* strain JM101 was transformed with pMON13183 for protein expression and protein isolation from inclusion bodies.

The plasmid, pMON13183, contains the DNA sequence of (SEQ ID NO:95) which encodes the following amino acid sequence:

```
Asn Cys Ser Ile Met Ile Asp Glu Ile Ile His His Leu Lys Arg  (SEQ ID NO:167)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr
```

EXAMPLE 55

Construction of pMON13184

The new N-terminus/C-terminus gene in pMON13184 was created using Method I as described in Materials and Methods. Fragment Start was created and amplified from G-CSF Ser[17] sequence in pMON13037 using the primer set, 97 start (SEQ ID NO:66) and L-11 start (SEQ ID NO:60). Fragment Stop was created and amplified from G-CSF Ser[17] sequence in pMON13037 using the primer set, 96 stop (SEQ ID NO:67) and L-11 stop (SEQ ID NO:61). The full-length new N terminus/C-terminus G-CSF Ser[17] gene was created and amplified from the annealed Fragments Start and Stop using 97 start and 96 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13184. *E. coli* strain JM101 was transformed with pMON13184 for protein expression and protein isolation from inclusion bodies.

The plasmid, pMON13184, contains the DNA sequence of (SEQ ID NO:96) which encodes the following amino acid sequence:

```
Asn Cys Ser Ile Met Ile Asp Glu Ile Ile His His Leu Lys Arg   (SEQ ID NO:168)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Ser Pro
Gly Gly Gly Ser Gly Gly Gly Ser Asn Met Ala Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro Thr Gln Gly Ala Met Pro Ala Phe Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Ser
Gly Gly Ser Gly Gly Ser Gln Ser Phe Leu Leu Lys Ser Leu Glu
Gln Val Arg Lys Ile Gln Gly Asp Gly Ala Ala Leu Gln Glu Lys
Leu Cys Ala Thr Tyr Lys Leu Cys His Pro Glu Glu Leu Val Leu
Leu Gly His Ser Leu Gly Ile Pro Trp Ala Pro Leu Ser Ser Cys
Pro Ser Gln Ala Leu Gln Leu Ala Gly Cys Leu Ser Gln Leu His
Ser Gly Leu Phe Leu Tyr Gln Gly Leu Leu Gln Ala Leu Glu Gly
Ile Ser
```

EXAMPLE 56

Construction of pMON13185

The new N-terminus/C-terminus gene in pMON13185 was created using Method I as described in Materials and Methods. Fragment Start was created and amplified from G-CSF Ser[17] sequence in pMON13037 using the primer set, 97 start (SEQ ID NO:66) and L-11 start (SEQ ID NO:60). Fragment Stop was created and amplified from G-CSF Ser[17] sequence in pMON13037 using the primer set, 96 stop (SEQ ID NO:67) and L-11 stop (SEQ ID NO:61). The full-length new N terminus/C-terminus G-CSF Ser[17] gene was created and amplified from the annealed Fragments Start and Stop using 97 start and 96 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13185.

*E. coli* strain JM101 was transformed with pMON13185 for protein expression and protein isolation from inclusion bodies.

The plasmid, pMON13185, contains the DNA sequence of (SEQ ID NO:67) which encodes the following amino acid sequence:

was created and amplified from the annealed Fragments Start and Stop using 126 start and 125 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the

```
Asn Cys Ser Ile Met Ile Asp Glu Ile Ile His His Leu Lys Arg  (SEQ ID NO:169)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser
```

EXAMPLE 57

Construction of pMON13186

The new N-terminus/C-terminus gene in pMON13186 was created using Method I as described in Materials and Methods. Fragment Start was created and amplified from G-CSF Ser[17] sequence in pMON13037 using the primer set, 126 start (SEQ ID NO:68) and L-11 start (SEQ ID NO:60). Fragment Stop was created and amplified from G-CSF Ser[17] sequence in pMON13037 using the primer set, 125 stop (SEQ ID NO:69) and L-11 stop (SEQ ID NO:61). The full-length new N terminus/C-terminus G-CSF Ser[17] gene ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13186.

*E. coli* strain JM101 was transformed with pMON13186 for protein expression and protein isolation from inclusion bodies.

The plasmid, pMON13186, contains the DNA sequence of (SEQ ID NO:98) which encodes the following amino acid sequence:

Asn Cys Ser Ile Met Ile Asp Glu Ile Ile His His Leu Lys Arg (SEQ ID NO:170)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Gly Gly Ser Gly Gly Gly Ser Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

Ser Gly Gly Ser Gly Gly Ser Gln Ser Phe Leu Leu Lys Ser Leu

Glu Gln Val Arg Lys Ile Gln Gly Asp Gly Ala Ala Leu Gln Glu

Lys Leu Cys Ala Thr Tyr Lys Leu Cys His Pro Glu Glu Leu Val

Leu Leu Gly His Ser Leu Gly Ile Pro Trp Ala Pro Leu Ser Ser

Cys Pro Ser Gln Ala Leu Gln Leu Ala Gly Cys Leu Ser Gln Leu

His Ser Gly Leu Phe Leu Tyr Gln Gly Leu Leu Gln Ala Leu Glu

Gly Ile Ser Pro Glu Leu Gly Pro Thr Leu Asp Thr Leu Gln Leu

Asp Val Ala Asp Phe Ala Thr Thr Ile Trp Gln Gln Met Glu Glu

Leu Gly

EXAMPLE 58

Construction of pMON13187

The new N-terminus/C-terminus gene in pMON13187 was created using Method I as described in Materials and Methods. Fragment Start was created and amplified from G-CSF Ser[17] sequence in pMON13037 using the primer set, 126 start (SEQ ID NO:68) and L-11 start (SEQ ID NO:60). Fragment Stop was created and amplified from G-CSF Ser[17] sequence in pMON13037 using the primer set, 125 stop (SEQ ID NO:69) and L-11 stop (SEQ ID NO:61). The full-length new N terminus/C-terminus G-CSF Ser[17] gene was created and amplified from the annealed Fragments Start and Stop using 126 start and 125 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5a cells (Life Technologies, Gaithersburg, Md.). Transformant bacteria were selected on ampicillin-containing plates. Plasmid DNA was isolated and sequenced to confirm the correct insert. The resulting plasmid was designated pMON13187.

*E. coli* strain JM101 was transformed with pMON13187 for protein expression and protein isolation from inclusion bodies.

The plasmid, pMON13187, contains the DNA sequence of (SEQ ID NO:99) which encodes the following amino acid sequence:

Asn Cys Ser Ile Met Ile Asp Glu Ile Ile His His Leu Lys Arg (SEQ ID NO:171)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

-continued

```
Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

Ser Gly Gly Ser Gly Gly Ser Gln Ser Phe Leu Leu Lys Ser Leu

Glu Gln Val Arg Lys Ile Gln Gly Asp Gly Ala Ala Leu Gln Glu

Lys Leu Cys Ala Thr Tyr Lys Leu Cys His Pro Glu Glu Leu Val

Leu Leu Gly His Ser Leu Gly Ile Pro Trp Ala Pro Leu Ser Ser

Cys Pro Ser Gln Ala Leu Gln Leu Ala Gly Cys Leu Ser Gln Leu

His Ser Gly Leu Phe Leu Tyr Gln Gly Leu Leu Gln Ala Leu Glu

Gly Ile Ser Pro Glu Leu Gly Pro Thr Leu Asp Thr Leu Gln Leu

Asp Val Ala Asp Phe Ala Thr Thr Ile Trp Gln Gln Met Glu Glu

Leu Gly
```

EXAMPLE 59

Construction of pMON13188

The new N-terminus/C-terminus gene in pMON13188 was created using Method I as described in Materials and Methods. Fragment Start was created and amplified from G-CSF Ser$^{17}$ sequence in pMON13037 using the primer set, 133 start (SEQ ID NO:70) and L-11 start (SEQ ID NO:60). Fragment Stop was created and amplified from G-CSF Ser$^{17}$ sequence in pMON13037 using the primer set, 132 stop (SEQ ID NO:71) and L-11 stop (SEQ ID NO:61). The full-length new N terminus/C-terminus G-CSF Ser$^{17}$ gene was created and amplified from the annealed Fragments Start and Stop using 133 start and 132 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13188.

E. coli strain JM101 was transformed with pMON13188 for protein expression and protein isolation from inclusion bodies.

The plasmid, pMON13188, contains the DNA sequence of (SEQ ID NO:100) which encodes the following amino acid sequence:

```
Asn Cys Ser Ile Met Ile Asp Glu Ile Ile His His Leu Lys Arg    (SEQ ID NO:172)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Thr Gln Gly Ala

Met Pro Ala Phe Ala Ser Ala Phe Gln Arg Arg Ala Gly Gly Val
```

-continued

```
Leu Val Ala Ser His Leu Gln Ser Phe Leu Glu Val Ser Tyr Arg

Val Leu Arg His Leu Ala Gln Pro Ser Gly Gly Ser Gly Gly Ser

Gln Ser Phe Leu Leu Lys Ser Leu Glu Gln Val Arg Lys Ile Gln

Gly Asp Gly Ala Ala Leu Gln Glu Lys Leu Cys Ala Thr Tyr Lys

Leu Cys His Pro Glu Glu Leu Val Leu Leu Gly His Ser Leu Gly

Ile Pro Trp Ala Pro Leu Ser Ser Cys Pro Ser Gln Ala Leu Gln

Leu Ala Gly Cys Leu Ser Gln Leu His Ser Gly Leu Phe Leu Tyr

Gln Gly Leu Leu Gln Ala Leu Glu Gly Ile Ser Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro
```

EXAMPLE 60

Construction of pMON13189

The new N-terminus/C-terminus gene in pMON13189 was created using Method I as described in Materials and Methods. Fragment Start was created and amplified from G-CSF Ser[17] sequence in pMON13037 using the primer set, 133 start (SEQ ID NO:70) and L-11 start (SEQ ID NO:60). Fragment Stop was created and amplified from G-CSF Ser[17] sequence in pMON13037 using the primer set, 132 stop (SEQ ID NO:71) and L-11 stop (SEQ ID NO:61). The full-length new N terminus/C-terminus G-CSF Ser[17] gene was created and amplified from the annealed Fragments Start and Stop using 133 start and 132 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13189.

*E. coli* strain JM101 was transformed with pMON13189 for protein expression and protein isolation from inclusion bodies.

The plasmid, pMON13189, contains the DNA sequence of (SEQ ID NO:101) which encodes the following amino acid sequence:

```
Asn Cys Ser Ile Met Ile Asp Glu Ile Ile His His Leu Lys Arg   (SEQ ID NO:173)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Thr Gln Gly Ala

Met Pro Ala Phe Ala Ser Ala Phe Gln Arg Arg Ala Gly Gly Val

Leu Val Ala Ser His Leu Gln Ser Phe Leu Glu Val Ser Tyr Arg

Val Leu Arg His Leu Ala Gln Pro Ser Gly Gly Ser Gly Gly Ser

Gln Ser Phe Leu Leu Lys Ser Leu Glu Gln Val Arg Lys Ile Gln

Gly Asp Gly Ala Ala Leu Gln Glu Lys Leu Cys Ala Thr Tyr Lys
```

-continued

Leu Cys His Pro Glu Glu Leu Val Leu Leu Gly His Ser Leu Gly

Ile Pro Trp Ala Pro Leu Ser Ser Cys Pro Ser Gln Ala Leu Gln

Leu Ala Gly Cys Leu Ser Gln Leu His Ser Gly Leu Phe Leu Tyr

Gln Gly Leu Leu Gln Ala Leu Glu Gly Ile Ser Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro

EXAMPLE 61

Construction of pMON13190

The new N-terminus/C-terminus gene in pMON13190 was created using Method I as described in Materials and Methods. Fragment Start was created and amplified from G-CSF Ser$^{17}$ sequence in pMON13037 using the primer set, 142 start (SEQ ID NO:72) and L-11 start (SEQ ID NO:60). Fragment Stop was created and amplified from G-CSF Ser$^{17}$ sequence in pMON13037 using the primer set, 141 stop (SEQ ID NO:73) and L-11 stop (SEQ ID NO:61). The full-length new N terminus/C-terminus G-CSF Ser$^{17}$ gene was created and amplified from the annealed Fragments Start and Stop using 142 start and 141 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13190.

*E. coli* strain JM101 was transformed with pMON13190 for protein expression and protein isolation from inclusion bodies.

The plasmid, pMON13190, contains the DNA sequence of (SEQ ID NO:102) which encodes the following amino acid sequence:

Asn Cys Ser Ile Met Ile Asp Glu Ile Ile His His Leu Lys Arg   (SEQ ID NO:174)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Gys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser Pro Glu Leu Gly Pro Thr Leu Asp Thr Leu Gln Leu Asp

Val Ala Asp Phe Ala Thr Thr Ile Trp Gln Gln Met Glu Glu Leu

-continued

```
Gly Met Ala Pro Ala Leu Gln Pro Thr Gln Gly Ala Met Pro Ala

Phe Ala
```

EXAMPLE 62

Construction of pMON13191

The new N-terminus/C-terminus gene in pMON13191 was created using Method I as described in Materials and Methods. Fragment Start was created and amplified from G-CSF Ser[17] sequence in pMON13037 using the primer set, 142 start (SEQ ID NO:72) and L-11 start (SEQ ID NO:60). Fragment Stop was created and amplified from G-CSF Ser[17] sequence in pMON13037 using the primer set, 141 stop (SEQ ID NO:73) and L-11 stop (SEQ ID NO:61). The full-length new N terminus/C-terminus G-CSF Ser[17] gene was created and amplified from the annealed Fragments Start and Stop using 142 start and 141 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13191.

*E. coli* strain JM101 was transformed with pMON13191 for protein expression and protein isolation from inclusion bodies.

The plasmid, pMON13191, contains the DNA sequence of (SEQ ID NO:103) which encodes the following amino acid sequence:

```
Asn Cys Ser Ile Met Ile Asp Glu Ile Tle His His Leu Lys Arg    (SEQ ID NO:175)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser Pro Glu Leu Gly Pro Thr Leu Asp Thr Leu Gln Leu Asp

Val Ala Asp Phe Ala Thr Thr Ile Trp Gln Gln Met Glu Glu Leu

Gly Met Ala Pro Ala Leu Gln Pro Thr Gln Gly Ala Met Pro Ala

Phe Ala
```

EXAMPLE 63

Construction of pMON13192

The new N-terminus/C-terminus gene in pMON13192 was created using Method II as described in Materials and Methods. Fragment Start was created and amplified from G-CSF sequence in pMON13037 using the primer set, 39 start (SEQ ID NO:64) and P-bl start (SEQ ID NO:62). Fragment Stop was created and amplified from G-CSF Ser[17] sequence in pMON13037 using the primer set, 38 stop (SEQ ID NO:65) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13192.

*E. coli* strain JM101 was transformed with pMON13192 for protein expression and protein isolation from inclusion bodies.

The plasmid, pMON13192, contains the DNA sequence of (SEQ ID NO:104) which encodes the following amino acid sequence:

```
13192.Pept                                                            (SEQ ID NO:176)
Asn Cys Ser Ile Met Ile Asp Glu Ile Ile His His Leu Lys Arg Pro Pro Ala Pro Leu Leu Asp Pro Asn Asn Leu Asn Asp Glu Asp Val Ser Ile Leu Met Asp Arg Asn Leu Arg Leu Pro Asn Leu Glu Ser Phe Val Arg Ala Val Lys Asn Leu Glu Asn Ala Ser Gly Ile Glu Ala Ile Leu Arg Asn Leu Gln Pro Cys Leu Pro Ser Ala Thr Ala Ala Pro Ser Arg His Pro Ile Ile Ile Lys Ala Gly Asp Trp Gln Glu Phe Arg Glu Lys Leu Thr Phe Tyr Leu Val Thr Leu Glu Gln Ala Gln Glu Gln Gln Tyr Val Glu Gly Gly Gly Ser Pro Gly Gly Gly Ser Gly Gly Gly Ser Asn Met Ala Tyr Lys Leu Cys His Pro Glu Glu Leu Val Leu Leu Gly His Ser Leu Gly Ile Pro Trp Ala Pro Leu Ser Ser Cys Pro Ser Gln Ala Leu Gln Leu Ala Gly Cys Leu Ser Gln Leu His Ser Gly Leu Phe Leu Tyr Gln Gly Leu Leu Gln Ala Leu Glu Gly Ile Ser Pro Glu Leu Gly Pro Thr Leu Asp Thr Leu Gln Leu Asp Val Ala Asp Phe Ala Thr Thr Ile Trp Gln Gln Met Glu Glu Leu Gly Met Ala Pro Ala Leu Gln Pro Thr Gln Gly Ala Met Pro Ala Phe Ala Ser Ala Phe Gln Arg Arg Ala Gly Gly Val Leu Val Ala Ser His Leu Gln Ser Phe Leu Glu Val Ser Tyr Arg Val Leu Arg His Leu Ala Gln Pro Thr Pro Leu Gly Pro Ala Ser Ser Leu Pro Gln Ser Phe Leu Leu Lys Ser Leu Glu Gln Val Arg Lys Ile Gln Gly Asp Gly Ala Ala Leu Gln Glu Lys Leu Cys Ala Thr
```

EXAMPLE 64

Construction of pMON13193

The new N-terminus/C-terminus gene in pMON13193 was created using Method II as described in Materials and Methods. Fragment Start was created and amplified from G-CSF Ser[17] sequence in pMON13037 using the primer set, 39 start (SEQ ID NO:64) and P-bl start (SEQ ID NO:62). Fragment Stop was created and amplified from G-CSF Ser[17] sequence in pMON13037 using the primer set, 38 stop (SEQ ID NO:65) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13193.

*E. coli* strain JM101 was transformed with pMON13193 for protein expression and protein isolation from inclusion bodies.

The plasmid, pMON13193, contains the DNA sequence of (SEQ ID NO:105) encodes the following amino acid sequence:

Fragment Stop was created and amplified from G-CSF Ser[17] sequence in pMON13037 using the primer set, 96 stop (SEQ ID NO:67) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restric-

```
Asn Cys Ser Ile Met Ile Asp Glu Ile Ile His His Leu Lys Arg    (SEQ ID NO:177)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Thr Pro Leu

Gly Pro Ala Ser Ser Leu Pro Gln Ser Phe Leu Leu Lys Ser Leu

Glu Gln Val Arg Lys Ile Gln Gly Asp Gly Ala Ala Leu Gln Glu

Lys Leu Cys Ala Thr
```

EXAMPLE 65

Construction of pMON25190

The new N-terminus/C-terminus gene in pMON25190 was created using Method II as described in Materials and Methods. Fragment Start was created and amplified from G-CSF sequence in pMON13037 using the primer set, 97 start (SEQ ID NO:66) and P-bl start (SEQ ID NO:62).

tion fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON25190.

E. coli strain JM101 was transformed with pMON25190 for protein expression and protein isolation from inclusion bodies.

The plasmid, pMON25190, contains the DNA sequence of (SEQ ID NO:106) which encodes the following amino acid sequence:

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated

```
Asn Cys Ser Ile Met Ile Asp Glu Ile Ile His His Leu Lys Arg     (SEQ ID NO:178)

Pro Pro Ala Pro Leu Leu Asp Pro Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser
```

EXAMPLE 66

Construction of pMON25191

The new N-terminus/C-terminus gene in pMON25191 was created using Method II as described in Materials and Methods. Fragment Start was created and amplified from G-CSF Ser[17] sequence in pMON13037 using the primer set, 97 start (SEQ ID NO:66) and P-bl start (SEQ ID NO:62). Fragment Stop was created and amplified from G-CSF Ser[17] sequence in pMON13037 using the primer set, 96 stop (SEQ ID NO:98) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON25191.

E. coli strain JM101 was transformed with pMON25191 for protein expression and protein isolation from inclusion bodies.

The plasmid, pMON25191, contains the DNA sequence of (SEQ ID NO:107) which encodes the following amino acid sequence:

Asn Cys Ser Ile Met Ile Asp Glu Ile Ile His His Leu Lys Arg   (SEQ ID NO:179)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser

EXAMPLE 67

Construction of pMON13194

The new N-terminus/C-terminus gene in pMON13194 was created using Method II as described in Materials and Methods. Fragment Start was created and amplified from G-CSF Ser$^{17}$ sequence in pMON13037 using the primer set, 126 start (SEQ ID NO:68) and P-bl start (SEQ ID NO:62). Fragment Stop was created and amplified from G-CSF Ser$^{17}$ sequence in pMON13037 using the primer set, 125 stop (SEQ ID NO:67) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser$^{17}$ gene and was digested with restriction endonucleases NcoI and HindIII. The digested DNA was resolved on a 1% TAE gel, stained with ethidium bromide and the full-length new N-terminus/C-terminus G-CSF Ser$^{17}$ gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13194.

E. coli strain JM101 was transformed with pMON13194 for protein expression and protein isolation from inclusion bodies.

The plasmid, pMON13194, contains the DNA sequence of (SEQ ID NO:108) which encodes the following amino acid sequence:

Asn Cys Ser Ile Met Ile Asp Glu Ile Ile His His Leu Lys Arg   (SEQ ID NO:180)

Pro Pro Ala Pro Leu Leu Asp Pro Asn Asn Leu Asn Asp Glu Asp

-continued

```
Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Gly Gly Ser Gly Gly Gly Ser Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

Thr Pro Leu Gly Pro Ala Ser Ser Leu Pro Gln Ser Phe Leu Leu

Lys Ser Leu Glu Gln Val Arg Lys Ile Gln Gly Asp Gly Ala Ala

Leu Gln Glu Lys Leu Cys Ala Thr Tyr Lys Leu Cys His Pro Glu

Glu Leu Val Leu Leu Gly His Ser Leu Gly Ile Pro Trp Ala Pro

Leu Ser Ser Cys Pro Ser Gln Ala Leu Gln Leu Ala Gly Cys Leu

Ser Gln Leu His Ser Gly Leu Phe Leu Tyr Gln Gly Leu Leu Gln

Ala Leu Glu Gly Ile Ser Pro Glu Leu Gly Pro Thr Leu Asp Thr

Leu Gln Leu Asp Val Ala Asp Phe Ala Thr Thr Ile Trp Gln Gln

Met Glu Glu Leu Gly
```

EXAMPLE 68

Construction of pMON13195

The new N-terminus/C-terminus gene in pMON13195 was created using Method II as described in Materials and Methods. Fragment Start was created and amplified from G-CSF Ser[17] sequence in pMON13037 using the primer set, 126 start (SEQ ID NO:68) and P-bl start (SEQ ID NO:62). Fragment Stop was created and amplified from G-CSF Ser[17] sequence in pMON13037 using the primer set, 125 stop (SEQ ID NO:69) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13195.

*E. coli* strain JM101 was transformed with pMON13195 for protein expression and protein isolation from inclusion bodies.

The plasmid, pMON13195, contains the DNA sequence of (SEQ ID NO:109) which encodes the following amino acid sequence:

```
Asn Cys Ser Ile Met Ile Asp Glu Ile Ile His His Leu Lys Arg   (SEQ ID NO:181)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr
```

-continued

```
Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

Thr Pro Leu Gly Pro Ala Ser Ser Leu Pro Gln Ser Phe Leu Leu

Lys Ser Leu Glu Gln Val Arg Lys Ile Gln Gly Asp Gly Ala Ala

Leu Gln Glu Lys Leu Cys Ala Thr Tyr Lys Leu Cys His Pro Glu

Glu Leu Val Leu Gly His Ser Leu Gly Ile Pro Trp Ala Pro

Leu Ser Ser Cys Pro Ser Gln Ala Leu Gln Leu Ala Gly Cys Leu

Ser Gln Leu His Ser Gly Leu Phe Leu Tyr Gln Gly Leu Leu Gln

Ala Leu Glu Gly Ile Ser Pro Glu Leu Gly Pro Thr Leu Asp Thr

Leu Gln Leu Asp Val Ala Asp Phe Ala Thr Thr Ile Trp Gln Gln

Met Glu Glu Leu Gly
```

EXAMPLE 69

Construction of pMON13196

The new N-terminus/C-terminus gene in pMON13196 was created using Method II as described in Materials and Methods. Fragment Start was created and amplified from G-CSF sequence in pMON13037 using the primer set, 133 start (SEQ ID NO:70) and P-bl start (SEQ ID NO:62). Fragment Stop was created and amplified from G-CSF Ser[17] sequence in pMON13037 using the primer set, 132 stop (SEQ ID NO:71) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13196.

E. coli strain JM101 was transformed with pMON13196 for protein expression and protein isolation from inclusion bodies.

The plasmid, pMON13196, contains the DNA sequence of (SEQ ID NO:110) which encodes the following amino acid sequence:

```
Asn Cys Ser Ile Met Ile Asp Glu Ile Ile His His Leu Lys Arg   (SEQ ID NO:182)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu
```

-continued

```
Gln Ala Gln Glu Gln Gln Tyr Val Glu Gly Gly Gly Gly Ser Pro

Gly Gly Gly Ser Gly Gly Gly Ser Asn Met Ala Thr Gln Gly Ala

Met Pro Ala Phe Ala Ser Ala Phe Gln Arg Arg Ala Gly Gly Val

Leu Val Ala Ser His Leu Gln Ser Phe Leu Glu Val Ser Tyr Arg

Val Leu Arg His Leu Ala Gln Pro Thr Pro Leu Gly Pro Ala Ser

Ser Leu Pro Gln Ser Phe Leu Leu Lys Ser Leu Glu Gln Val Arg

Lys Ile Gln Gly Asp Gly Ala Ala Leu Gln Glu Lys Leu Cys Ala

Thr Tyr Lys Leu Cys His Pro Glu Glu Leu Val Leu Leu Gly His

Ser Leu Gly Ile Pro Trp Ala Pro Leu Ser Ser Cys Pro Ser Gln

Ala Leu Gln Leu Ala Gly Cys Leu Ser Gln Leu His Ser Gly Leu

Phe Leu Tyr Gln Gly Leu Leu Gln Ala Leu Glu Gly Ile Ser Pro

Glu Leu Gly Pro Thr Leu Asp Thr Leu Gln Leu Asp Val Ala Asp

Phe Ala Thr Thr Ile Trp Gln Gln Met Glu Glu Leu Gly Met Ala

Pro Ala Leu Gln Pro
```

EXAMPLE 70

Construction of pMON13197

The new N-terminus/C-terminus gene in pMON13197 was created using Method II as described in Materials and Methods. Fragment Start was created and amplified from G-CSF Ser$^{17}$ sequence in pMON13037 using the primer set, 133 start (SEQ ID NO:70) and P-bl start (SEQ ID NO:62). Fragment Stop was created and amplified from G-CSF Ser$^{17}$ sequence in pMON13037 using the primer set, 132 stop (SEQ ID NO:71) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser$^{17}$ gene and was digested with restriction endonucleases NcoI and HindIII. The digested DNA was resolved on a 1% TAE gel, stained with ethidium bromide and the full-length new N-terminus/C-terminus G-CSF Ser$^{17}$ gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13197.

*E. coli* strain JM101 was transformed with pMON13197 for protein expression and protein isolation from inclusion bodies.

The plasmid, pMON13197, contains the DNA sequence of (SEQ ID NO:111) which encodes the following amino acid sequence:

```
Asn Cys Ser Ile Met Ile Asp Glu Ile Ile His His Leu Lys Arg    (SEQ ID NO:183)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Tyr Lys Leu Cys

His Pro Glu Glu Leu Val Leu Leu Gly His Ser Leu Gly Ile Pro
```

-continued

```
Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Thr Pro Leu

Gly Pro Ala Ser Ser Leu Pro Gln Ser Phe Leu Leu Lys Ser Leu

Glu Gln Val Arg Lys Ile Gln Gly Asp Gly Ala Ala Leu Gln Glu

Lys Leu Cys Ala Thr
```

EXAMPLE 71

Construction of pMON13198

The new N-terminus/C-terminus gene in pMON13198 was created using Method II as described in Materials and Methods. Fragment Start was created and amplified from G-CSF sequence in pMON13037 using the primer set, 142 start (SEQ ID NO:72) and P-bl start (SEQ ID NO:62). Fragment Stop was created and amplified from G-CSF Ser$^{17}$ sequence in pMON13037 using the primer set, 141 stop (SEQ ID NO:73) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser$^{17}$ gene and was digested with restriction endonucleases NcoI and HindIII. The digested DNA was resolved on a 1% TAE gel, stained with ethidium bromide and the full-length new N-terminus/C-terminus G-CSF Ser$^{17}$ gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13198.

*E. coli* strain JM101 was transformed with pMON13198 for protein expression and protein isolation from inclusion bodies.

The plasmid, pMON13198, contains the DNA sequence of (SEQ ID NO:112) which encodes the following amino acid sequence:

```
Asn Cys Ser Ile Met Ile Asp Glu Ile Ile His His Leu Lys Arg  (SEQ ID NO:184)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Gly Gly Ser Gly Gly Gly Ser Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu
```

-continued

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser Pro Glu Leu Gly Pro Thr Leu Asp Thr Leu

Gln Leu Asp Val Ala Asp Phe Ala Thr Thr Ile Trp Gln Gln Met

Glu Glu Leu Gly Met Ala Pro Ala Leu Gln Pro Thr Gln Gly Ala

Met Pro Ala Phe Ala

EXAMPLE 72

Construction of pMON13199

The new N-terminus/C-terminus gene in pMON13199 was created using Method II as described in Materials and Methods. Fragment Start was created and amplified from G-CSF Ser$^{17}$ sequence in pMON13037 using the primer set, 142 start (SEQ ID NO:72) and P-bl start (SEQ ID NO:62). Fragment Stop was created and amplified from G-CSF Ser$^{17}$ sequence in pMON13037 using the primer set, 141 stop (SEQ ID NO:73) and P-bl stop (SEQ ID NO:63). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser$^{17}$ gene and was digested with restriction endonucleases NcoI and HindIII. The digested DNA was resolved on a 1% TAE gel, stained with ethidium bromide and the full-length new N-terminus/C-terminus G-CSF Ser$^{17}$ gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13199.

*E. coli* strain JM101 was transformed with pMON13199 for protein expression and protein isolation from inclusion bodies.

The plasmid, pMON13199, contains the DNA sequence of (SEQ ID NO:113) which encodes the following amino acid sequence:

Asn Cys Ser Ile Met Ile Asp Glu Ile Ile His His Leu Lys Arg (SEQ ID NO:185)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

-continued
```
Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser Pro Glu Leu Gly Pro Thr Leu Asp Thr Leu

Gln Leu Asp Val Ala Asp Phe Ala Thr Thr Ile Trp Gln Gln Met

Glu Glu Leu Gly Met Ala Pro Ala Leu Gln Pro Thr Gln Gly Ala

Met Pro Ala Phe Ala
```

EXAMPLE 73

Construction of Tandemly-duplicated Plasmid Template, Syntan1

To create the tandemly-duplicated hIL-3 receptor agonist pMON13416 template, Syntan1, three DNAs were joined by means of ligation using T4 DNA ligase (Boehringer Mannheim). The three DNAs are: 1) pMON13046, containing hIL-3 receptor agonist pMON13416, digested with BstEII and SnaBI; 2) the annealed complimentary pair of synthetic oligonucleotides, L1syn.for (SEQ ID NO:48) and L1syn.rev (SEQ ID NO:49), which contain sequence encoding the linker that connects the C-terminal and N-terminal ends of the original protein and a small amount of surrounding pMON13416 sequence and which when properly assembled result in BstEII and ClaI ends; and 3) a portion of hIL-3 receptor agonist pMON13416 digested from pMON13046 with ClaI (DNA had been grown in the dam-cells, DM1 (Life Technologies)) and SnaBI. The digested DNAs were resolved on a 0.9% TAE gel, stained with ethidium bromide and isolated using Geneclean (Bio101).

A portion of the ligation reaction was used to transform E. coli strain DH5α cells (Life Technologies, Gaithersburg, Md.). Miniprep DNA was isolated from the transformants, and the transformants were screened using a PCR based assay. Plasmid DNA from selected transformants was sequenced to obtain the correct template. The resulting plasmid was designated syntan1 and contains the DNA sequence of (SEQ ID NO:84).

EXAMPLE 74

Construction of Tandemly-duplicated Template, Syntan3

To create the tandemly-duplicated hIL-3 receptor agonist pMON13416 template, syntan3, three DNAs were joined by means of ligation using T4 DNA ligase (Boehringer Mannheim). The three DNAs are: 1) pMON13046, containing hIL-3 receptor agonist pMON13416, digested with BstEII and SnaBI; 2) the annealed complimentary pair of synthetic oligonucleotides, L3syn.for (SEQ ID NO:50) and L3syn.rev (SEQ ID NO:51), which contain sequence encoding the linker that connects the C-terminal and N-terminal ends of the original protein and a small amount of surrounding pMON13416 sequence and which when properly assembled result in BstEII and SnaBI ends; and 3) a portion of hIL-3 receptor agonist pMON13416 digested from pMON13046 with ClaI (DNA had been grown in the dam-cells, DM1 (Life Technologies)) and SnaBI. The digested DNAs were resolved on a 0.9% TAE gel, stained with ethidium bromide and isolated using Geneclean (Bio101).

A portion of the ligation reaction was used to transform E. coli strain DH5α cells (Life Technologies, Gaithersburg, Md.). Miniprep DNA was isolated from the transformants, and the transformants were screened using a PCR based assay. Plasmid DNA from selected transformants was sequenced to obtain the correct template. The resulting plasmid was designated syntan3 and contains the DNA sequence of (SEQ ID NO:85).

EXAMPLE 75

Construction of pMON31104

The new N-terminus/C-terminus gene in pMON31104 was created using Method III as described in Materials and Methods. The full length new N-terminus/C-terminus gene of hIL-3 receptor agonist pMON13416 was created and amplified from the intermediate plasmid, Syntan1, using the primer set 35 start (SEQ ID NO:52) and 34 rev (SEQ ID NO:53).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector, pMON13189, using T4 DNA ligase (Boehringer Mannheim, Indianapolis, Ind.). The pMON13189 DNA had been previously digested with NcoI and SnaBI to remove the hIL-3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31104.

E. coli strain JM101 was transformed with pMON31104 for protein expression and protein isolation from inclusion bodies.

The plasmid, pMON31104, contains the DNA sequence of (SEQ ID NO:86) which encodes the following amino acid sequence:

Leu Asp Pro Asn Asn Leu Asn Asp Glu Asp Val Ser Ile Leu Met (SEQ ID NO:186)

Asp Arg Asn Leu Arg Leu Pro Asn Leu Glu Ser Phe Val Arg Ala

Val Lys Asn Leu Glu Asn Ala Ser Gly Ile Glu Ala Ile Leu Arg

Asn Leu Gln Pro Cys Leu Pro Ser Ala Thr Ala Ala Pro Ser Arg

His Pro Ile Ile Ile Lys Ala Gly Asp Trp Gln Glu Phe Arg Glu

Lys Leu Thr Phe Tyr Leu Val Thr Leu Glu Gln Ala Gln Glu Gln

Gln Gly Gly Gly Ser Asn Cys Ser Ile Met Ile Asp Glu Ile Ile

His His Leu Lys Arg Pro Pro Ala Pro Leu Tyr Val Glu Gly Gly

Gly Gly Ser Pro Gly Glu Pro Ser Gly Pro Ile Ser Thr Ile Asn

Pro Ser Pro Pro Ser Lys Glu Ser His Lys Ser Pro Asn Met Ala

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Tyr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro

EXAMPLE 76

Construction of pMON31105

The new N-terminus/C-terminus gene in pMON31105 was created using Method III as described in Materials and Methods. The full length new N-terminus/C-terminus gene of hIL-3 receptor agonist pMON13416 was created and amplified from the intermediate plasmid, Syntan1, using the primer set 70 start (SEQ ID NO:54) and 69 rev (SEQ ID NO:55).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the $hIL_3$ receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31105.

*E. coli* strain JM101 was transformed with pMON31105 for protein expression and protein isolation from inclusion bodies.

The plasmid, pMON31105, contains the DNA sequence of (SEQ ID NO:87) which encodes the protein with the following amino acid sequence:

Asn Ala Ser Gly Ile Glu Ala Ile Leu Arg Asn Leu Gln Pro Cys (SEQ ID NO:187)

Leu Pro Ser Ala Thr Ala Ala Pro Ser Arg His Pro Ile Ile Ile

Lys Ala Gly Asp Trp Gln Glu Phe Arg Glu Lys Leu Thr Phe Tyr

Leu Val Thr Leu Glu Gln Ala Gln Glu Gln Gln Gly Gly Gly Ser

Asn Cys Ser Ile Met Ile Asp Glu Ile Ile His His Leu Lys Arg

-continued

```
Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Tyr Val Glu Gly Gly

Gly Gly Ser Pro Gly Glu Pro Ser Gly Pro Ile Ser Thr Ile Asn

Pro Ser Pro Ser Lys Glu Ser His Lys Ser Pro Asn Met Ala

Thr Gln Gly Ala Met Pro Ala Phe Ala Ser Ala Phe Gln Arg Arg

Ala Gly Gly Val Leu Val Ala Ser His teu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Thr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro
```

EXAMPLE 77

Construction of pMON31106

The new N-terminus/C-terminus gene in pMON31106 was created using Method III as described in Materials and Methods. The full length new N-terminus/C-terminus gene of hIL-3 receptor agonist pMON13416 was created and amplified from the intermediate plasmid, Syntan1, using the primer set 91 start (SEQ ID NO:56) and 90 rev (SEQ ID NO:57).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31106.

*E. coli* strain JM101 was transformed with pMON31106 for protein expression and protein isolation from inclusion bodies.

The plasmid, pMON31106, contains the DNA sequence of (SEQ ID NO:80) which encodes the protein with the following amino acid sequence:

Ala Pro Ser Arg His Pro Ile Ile Ile Lys Ala Gly Asp Trp Gln (SEQ ID NO:188)
Glu Phe Arg Glu Lys Leu Thr Phe Tyr Leu Val Thr Leu Glu Gln
Ala Gln Glu Gln Gln Gly Gly Gly Ser Asn Cys Ser Ile Met Ile
Asp Glu Ile Ile His His Leu Lys Arg Pro Pro Ala Pro Leu Leu
Asp Pro Asn Asn Leu Asn Asp Glu Asp Val Ser Ile Leu Met Asp
Arg Asn Leu Arg Leu Pro Asn Leu Glu Ser Phe Val Arg Ala Val
Lys Asn Leu Glu Asn Ala Ser Gly Ile Glu Ala Ile Leu Arg Asn
Leu Gln Pro Cys Leu Pro Ser Ala Thr Ala Tyr Val Glu Gly Gly
Gly Gly Ser Pro Gly Glu Pro Ser Gly Pro Ile Ser Thr Ile Asn

-continued

```
Pro Ser Pro Pro Ser Lys Glu Ser His Lys Ser Pro Asn Met Ala

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Tyr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro
```

EXAMPLE 78

Construction of pMON31107

The new N-terminus/C-terminus gene in pMON31107 was created using Method III as described in Materials and Methods. The full length new N-terminus/C-terminus gene of hIL-3 receptor agonist pMON13416 was created and amplified from the intermediate plasmid, Syntan1, using the primer set 101 start (SEQ ID NO:58) and 100 rev (SEQ ID NO:59).

The resulting DNA fragment which contains the new gene was digested with restriction endonucleases NcoI and SnaBI. The digested The DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31107.

*E. coli* strain JM101 was transformed with pMON31107 for protein expression and protein isolation from inclusion bodies.

The plasmid, pMON31107, contains the DNA sequence of (SEQ ID NO:89) which encodes the following amino acid sequence:

```
Ala Gly Asp Trp Gln Glu Phe Arg Glu Lys Leu Thr Phe Tyr Leu  (SEQ ID NO:189)

Val Thr Leu Glu Gln Ala Gln Glu Gln Gly Gly Gly Ser Asn

Cys Ser Ile Met Ile Asp Glu Ile Ile His Leu Lys Arg Pro

Pro Ala Pro Leu Leu Asp Pro Asn Leu Asn Asp Glu Asp Val

Ser Ile Leu Met Asp Arg Asn Leu Arg Leu Pro Asn Leu Glu Ser

Phe Val Arg Ala Val Lys Asn Leu Glu Asn Ala Ser Gly Ile Glu

Ala Ile Leu Arg Asn Leu Gln Pro Cys Leu Pro Ser Ala Thr Ala

Ala Pro Ser Arg His Pro Ile Ile Ile Lys Tyr Val Glu Gly Gly

Gly Gly Ser Pro Gly Glu Pro Ser Gly Pro Ile Ser Thr Ile Asn

Pro Ser Pro Pro Ser Lys Glu Ser His Lys Ser Pro Asn Met Ala

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly
```

-continued

```
Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Tyr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro
```

EXAMPLE 79

Construction of pMON31108

The new N-terminus/C-terminus gene in pMON31108 was created using Method III as described in Materials and Methods. The full length new N-terminus/C-terminus gene of hIL-3 receptor agonist pMON13416 was created and amplified from the intermediate plasmid, Syntan3, using the primer set 35 start (SEQ ID NO:52) and 34 rev (SEQ ID NO:53).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL$_3$ receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31108.

*E. coli* strain JM101 was transformed with pMON31108 for protein expression and protein isolation from inclusion bodies.

The plasmid, pMON31108, contains the DNA sequence of (SEQ ID NO:90) which encodes the following amino acid sequence:

```
Leu Asp Pro Asn Asn Leu Asn Asp Glu Asp Val Ser Ile Leu Met  (SEQ ID NO:190)

Asp Arg Asn Leu Arg Leu Pro Asn Leu Glu Ser Phe Val Arg Ala

Val Lys Asn Leu Glu Asn Ala Ser Gly Ile Glu Ala Ile Leu Arg

Asn Leu Gln Pro Cys Leu Pro Ser Ala Thr Ala Ala Pro Ser Arg

His Pro Ile Ile Ile Lys Ala Gly Asp Trp Gln Glu Phe Arg Glu

Lys Leu Thr Phe Tyr Leu Val Thr Leu Glu Gln Ala Gln Glu Gln

Gln Gly Gly Gly Ser Gly Gly Gly Ser Gly Gly Gly Ser Asn Cys

Ser Ile Met Ile Asp Glu Ile Ile His His Leu Lys Arg Pro Pro

Ala Pro Leu Tyr Val Glu Gly Gly Gly Ser Pro Gly Glu Pro

Ser Gly Pro Ile Ser Thr Ile Asn Pro Ser Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly
```

-continued

```
Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro
```

EXAMPLE 80

Construction of pMON31109

The new N-terminus/C-terminus gene in pMON31109 was created using Method III as described in Materials and Methods. The full length new N-terminus/C-terminus gene of hIL-3 receptor agonist pMON13416 was created and amplified from the intermediate plasmid, Syntan3, using the primer set 70 start (SEQ ID NO:54) and 69 rev (SEQ ID NO:55).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL$_3$ receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31109.

*E. coli* strain JM101 was transformed with pMON31109 for protein expression and protein isolation from inclusion bodies.

The plasmid, pMON31109, contains the DNA sequence of (SEQ ID NO:91) which encodes the following amino acid sequence:

```
Asn Ala Ser Gly Ile Glu Ala Ile Leu Arg Asn Leu Gln Pro Cys  (SEQ ID NO:191)

Leu Pro Ser Ala Thr Ala Ala Pro Ser Arg His Pro Ile Ile Ile

Lys Ala Gly Asp Trp Gln Glu Phe Arg Glu Lys Leu Thr Phe Tyr

Leu Val Thr Leu Glu Gln Ala Gln Glu Gln Gln Gly Gly Gly Ser

Gly Gly Gly Ser Gly Gly Gly Ser Asn Cys Ser Ile Met Ile Asp

Glu Ile Ile His His Leu Lys Arg Pro Pro Ala Pro Leu Leu Asp

Pro Asn Asn Leu Asn Asp Glu Asp Val Ser Ile Leu Met Asp Arg

Asn Leu Arg Leu Pro Asn Leu Glu Ser Phe Val Arg Ala Val Lys

Asn Leu Glu Tyr Val Glu Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro
```

EXAMPLE 81

Construction of pMON31110

The new N-terminus/C-terminus gene in pMON31110 was created using Method III as described in Materials and Methods. The full length new N-terminus/C-terminus gene of hIL-3 receptor agonist pMON13416 was created and amplified from the intermediate plasmid, Syntan3, using the primer set 91 start (SEQ ID NO:56) and 90 rev (SEQ ID NO:57).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31110.

E. coli strain JM101 was transformed with pMON31110 for protein expression and protein isolation from inclusion bodies.

The plasmid, pMON31110, contains the DNA sequence of (SEQ ID NO:92) which encodes the following amino acid sequence:

```
Ala Pro Ser Arg His Pro Ile Ile Ile Lys Ala Gly Asp Trp Gln  (SEQ ID NO:192)
Glu Phe Arg Glu Lys Leu Thr Phe Tyr Leu Val Thr Leu Glu Gln
Ala Gln Glu Gln Gln Gly Gly Ser Gly Gly Gly Ser Gly Gly
Gly Ser Asn Cys Ser Ile Met Ile Asp Glu Ile Ile His His Leu
Lys Arg Pro Pro Ala Pro Leu Leu Asp Pro Asn Asn Leu Asn Asp
Glu Asp Val Ser Ile Leu Met Asp Arg Asn Leu Arg Leu Pro Asn
Leu Glu Ser Fhe Val Arg Ala Val Lys Asn Leu Glu Asn Ala Ser
Gly Ile Glu Ala Ile Leu Arg Asn Leu Gln Pro Cys Leu Pro Ser
Ala Thr Ala Tyr Val Glu Gly Gly Gly Ser Pro Gly Glu Pro
Ser Gly Pro Ile Ser Thr Ile Asn Pro Ser Pro Pro Ser Lys Glu
Ser His Lys Ser Pro Asn Met Ala Thr Gln Gly Ala Met Pro Ala
Phe Ala Ser Ala Phe Gln Arg Arg Ala Gly Gly Val Leu Val Ala
Ser His Leu Gln Ser Phe Leu Glu Val Ser Tyr Arg Val Leu Arg
His Leu Ala Gln Pro Ser Gly Gly Ser Gly Gly Ser Gln Ser Phe
Leu Leu Lys Ser Leu Glu Gln Val Arg Lys Ile Gln Gly Asp Gly
Ala Ala Leu Gln Glu Lys Leu Cys Ala Thr Tyr Lys Leu Cys His
Pro Glu Glu Leu Val Leu Leu Gly His Ser Leu Gly Ile Pro Trp
Ala Pro Leu Ser Ser Cys Pro Ser Gln Ala Leu Gln Leu Ala Gly
Cys Leu Ser Gln Leu His Ser Gly Leu Phe Leu Tyr Gln Gly Leu
Leu Gln Ala Leu Glu Gly Ile Ser Pro Glu Leu Gly Pro Thr Leu
Asp Thr Leu Gln Leu Asp Val Ala Asp Phe Ala Thr Thr Ile Trp
Gln Gln Met Glu Glu Leu Gly Met Ala Pro Ala Leu Gln Pro
```

EXAMPLE 82

Construction of pMON31111

The new N-terminus/C-terminus gene in pMON31111 was created using Method III as described in Materials and Methods. The full length new N-terminus/C-terminus gene of hIL-3 receptor agonist pMON13416 was created and amplified from the intermediate plasmid, Syntan3, using the primer set 101 start (SEQ ID NO:58) and 100 rev (SEQ ID NO:59).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL$_3$ receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31111.

E. coli strain JM101 was transformed with pMON31111 for protein expression and protein isolation from inclusion bodies.

The plasmid, pMON31111, contains the DNA sequence of (SEQ ID NO:93) which encodes the following amino acid sequence:

EXAMPLE 83

Construction of pMON31112

Construction of pMON31112, a plasmid containing DNA sequence encoding a multi-functional hematopoietic receptor agonist which activates the hIL-3 receptor and G-CSF receptor. Plasmid, pMON13189 DNA was digested with restriction enzymes NcoI and XmaI resulting in an NcoI, XmaI vector fragment that was isolated and purified from a 0.8% agarose gel. The DNA from a second plasmid, pMON13222 (WO 94/12639, U.S. Ser. No. 08/411,796) was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:240) and SYNNOXA2.REQ (SEQ ID NO:241) were annealed and ligated with the 281 base pair DNA fragment from pMON13222 to the DNA vector fragment from pMON13189. A portion of the ligation mixture was then transformed into E. coli K-12 strain JM101. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31112, contains the DNA sequence of (SEQ ID NO:114) which encodes the following amino acid sequence:

```
Ala Gly Asp Trp Gln Glu Phe Arg Glu Lys Leu Thr Phe Tyr Leu  (SEQ ID NO:193)

Val Thr Leu Glu Gln Ala Gln Glu Gln Gln Gly Gly Gly Ser Gly

Gly Gly Ser Gly Gly Gly Ser Asn Cys Ser Ile Met Ile Asp Glu

Ile Ile His His Leu Lys Arg Pro Pro Ala Pro Leu Leu Asp Pro

Asn Asn Leu Asn Asp Glu Asp Val Ser Ile Leu Met Asp Arg Asn

Leu Arg Leu Pro Asn Leu Glu Ser Phe Val Arg Ala Val Lys Asn

Leu Glu Asn Ala Ser Gly Ile Glu Ala Ile Leu Arg Asn Leu Gln

Pro Cys Leu Pro Ser Ala Thr Ala Ala Pro Ser Arg His Pro Ile

Ile Ile Lys Tyr Val Glu Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro
```

MetAlaAsnCysSerAsnMetIleAspGluIleIleThrHisLeuLysGlnProPro (SEQ ID NO:199)

LeuProLeuLeuAspPheAsnAsnLeuAsnGlyGluAspGlnAspIleLeuMetAsp

AsnAsnLeuArgArgProAsnLeuGluAlaPheAsnArgAlaValLysSerLeuGln

AsnAlaSerAlaIleGluSerIleLeuLysAsnLeuLeuProCysLeuProLeuAla

ThrAlaAlaProThrArgHisProIleHisIleLysAspGlyAspTrpAsnGluPhe

ArgArgLysLeuThrPheTyrLeuLysThrLeuGluAsnAlaGlnAlaGlnGlnTyr

ValGluGlyGlyGlySerProGlyGluProSerGlyProIleSerThrIleAsn

ProSerProProSerLysGluSerHisLysSerProAsnMetAlaThrGlnGlyAla

MetProAlaPheAlaSerAlaPheGlnArgArgAlaGlyGlyValLeuValAlaSer

HisLeuGlnSerPheLeuGluValSerTyrArgValLeuArgHisLeuAlaGlnPro

SerGlyGlySerGlyGlySerGlnSerPheLeuLeuLysSerLeuGluGlnValArg

LysIleGlnGlyAspGlyAlaAlaLeuGlnGluLysLeuCysAlaThrTyrLysLeu

CysHisProGluGluLeuValLeuLeuGlyHisSerLeuGlyIleProTrpAlaPro

LeuSerSerCysProSerGlnAlaLeuGlnLeuAlaGlyCysLeuSerGlnLeuHis

SerGlyLeuPheLeuTyrGlnGlyLeuLeuGlnAlaLeuGluGlyIleSerProGlu

LeuGlyProThrLeuAspThrLeuGlnLeuAspValAlaAspPheAlaThrThrIle

TrpGlnGlnMetGluGluLeuGlyMetAlaProAlaLeuGlnPro

Construction of pMON31113

Construction of pMON31113, a plasmid containing DNA sequence encoding a multi-functional hematopoietic receptor agonist which activates the hIL-3 receptor and G-CSF receptor. Plasmid, pMON13197 DNA was digested with restriction enzymes NcoI and XmaI resulting in an NcoI, XmaI vector fragment that was isolated and purified from a 0.8% agarose gel. The DNA from a second plasmid, pMON13239 (WO 94/12639, U.S. Ser. No. 08/411,796) was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:240) and SYNNOXA2.REQ (SEQ ID NO:241) were annealed and ligated with the 281 base pair DNA fragment from pMON13239 to the DNA vector fragment from pMON13197. A portion of the ligation mixture was then transformed into *E. coli* K-12 strain JM101. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31113, contains the DNA sequence of (SEQ ID NO:115) which encodes the following amino acid sequence:

MetAlaAsnCysSerAsnMetIleAspGluIleIleThrHisLeuLysGlnProPro (SEQ ID NO:200)
LeuProLeuLeuAspPheAsnAsnLeuAsnGlyGluAspGlnAspIleLeuMetGlu
AsnAsnLeuArgArgProAsnLeuGluAlaPheAsnArgAlaValLysSerLeuGln
AsnAlaSerAlaIleGluSerIleLeuLysAsnLeuLeuProCysLeuProLeuAla
ThrAlaAlaProThrArgHisProIleIleIleArgAspGlyAspTrpAsnGluPhe
ArgArgLysLeuThrPheTyrLeuLysThrLeuGluAsnAlaGlnAlaGlnGlnTyr
ValGluGlyGlyGlyGlySerProGlyGluProSerGlyProIleSerThrIleAsn
ProSerProProSerLysGluSerHisLysSerProAsnMetAlaThrGlnGlyAla
MetProAlaPheAlaSerAlaPheGlnArgArgAlaGlyGlyValLeuValAlaSer
HisLeuGlnSerPheLeuGluValSerTyrArgValLeuArgHisLeuAlaGlnPro
ThrProLeuGlyProAlaSerSerLeuProGlnSerPheLeuLeuLysSerLeuGlu
GlnValArgLysIleGlnGlyAspGlyAlaAlaLeuGlnGluLysLeuCysAlaThr
TyrLysLeuCysHisProGluGluLeuValLeuLeuGlyHisSerLeuGlyIlePro

-continued

```
TrpAlaProLeuSerSerCysProSerGlnAlaLeuGlnLeuAlaGlyCysLeuSer

GlnLeuHisSerGlyLeuPheLeuTyrGlnGlyLeuLeuGlnAlaLeuGluGlyIle

SerProGluLeuGlyProThrLeuAspThrLeuGlnLeuAspValAlaAspPheAla

ThrThrIleTrpGlnGlnMetGluGluLeuGlyMetAlaProAlaLeuGlnPro
```

EXAMPLE 85

Construction of pMON31114

Construction of pMON31114, a plasmid containing DNA sequence encoding a multi-functional hematopoietic receptor agonist which activates the hIL-3 receptor and G-CSF receptor. Plasmid, pMON13189 DNA was digested with restriction enzymes NcoI and XmaI resulting in an NcoI, XmaI vector fragment that was isolated and purified from a 0.8% agarose gel. The DNA from a second plasmid, pMON13239 (WO 94/12639, U.S. Ser. No. 08/411,796), was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:240) and SYNNOXA2.REQ (SEQ ID NO:241) were annealed and ligated with the 281 base pair DNA fragment from pMON13239 to the DNA vector fragment from pMON13189. A portion of the ligation mixture was then transformed into *E. coli* K-12 strain JM10l. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31114, contains the DNA sequence of (SEQ ID NO:116) which encodes the following amino acid sequence:

MetAlaAsnCysSerAsnMetIleAspGluIleIleThrHisLeuLysGlnProPro (SEQ ID NO:201)

LeuProLeuLeuAspPheAsnAsnLeuAsnGlyGluAspGlnAspIleLeuMetGlu

AsnAsnLeuArgArgProAsnLeuGluAlaPheAsnArgAlaValLysSerLeuGln

AsnAlaSerAlaIleGluSerIleLeuLysAsnLeuLeuProCysLeuProLeuAla

ThrAlaAlaProThrArgHisProIleIleIleArgAspGlyAspTrpAsnGluPhe

ArgArgLysLeuThrPheTyrLeuLysThrLeuGluAsnAlaGlnAlaGlnGlnTyr

ValGluGlyGlyGlyGlySerProGlyGluProSerGlyProIleSerThrIleAsn

ProSerProProSerLysGluSerHisLysSerProAsnMetAlaThrGlnGlyAla

MetProAlaPheAlaSerAlaPheGlnArgArgAlaGlyGlyValLeuValAlaSer

HisLeuGlnSerPheLeuGluValSerTyrArgValLeuArgHisLeuAlaGlnPro

SerGlyGlySerGlyGlySerGlnSerPheLeuLeuLysSerLeuGluGlnValArg

LysIleGlnGlyAspGlyAlaAlaLeuGlnGluLysLeuCysAlaThrTyrLysLeu

CysHisProGluGluLeuValLeuLeuGlyHisSerLeuGlyIleProTrpAlaPro

LeuSerSerCysProSerGlnAlaLeuGlnLeuAlaGlyCysLeuSerGlnLeuHis

SerGlyLeuPheLeuTyrGlnGlyLeuLeuGlnAlaLeuGluGlyIleSerProGlu

LeuGlyProThrLeuAspThrLeuGlnLeuAspValAlaAspPheAlaThrThrIle

TrpGlnGlnMetGluGluLeuGlyMetAlaProAlaLeuGlnPro

EXAMPLE 86

Construction of pMON31115

Construction of pMON31115, a plasmid containing DNA sequence encoding a multi-functional hematopoietic receptor agonist which activates the hIL-3 receptor and G-CSF receptor. Plasmid, pMON13197 DNA was digested with restriction enzymes NcoI and XmaI resulting in an NcoI, XmaI vector fragment that was isolated and purified from a 0.8% agarose gel. The DNA from a second plasmid, pMON13222, was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:240) and SYNNOXA2.REQ (SEQ ID NO:241) were annealed and ligated with the 281 base pair DNA fragment from pMON13222 to the DNA vector fragment from pMON13197. A portion of the ligation mixture was then transformed into *E. coli* K-12 strain JM101. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31115, contains the DNA sequence of (SEQ ID NO:117) which encodes the following amino acid sequence:

MetAlaAsnCysSerAsnMetIleAspGluIleIleThrHisLeuLysGlnProPro  (SEQ ID NO:202)

LeuProLeuLeuAspPheAsnAsnLeuAsnGlyGluAspGlnAspIleLeuMetAsp

AsnAsnLeuArgArgProAsnLeuGluAlaPheAsnArgAlaValLysSerLeuGln

AsnAlaSerAlaIleGluSerIleLeuLysAsnLeuLeuProCysLeuProLeuAla

ThrAlaAlaProThrArgHisProIleHisIleLysAspGlyAspTrpAsnGluPhe

ArgArgLysLeuThrPheTyrLeuLysThrLeuGluAsnAlaGlnAlaGlnGlnTyr

ValGluGlyGlyGlySerProGlyGluProSerGlyProIleSerThrIleAsn

ProSerProProSerLysGluSerHisLysSerProAsnMetAlaThrGlnGlyAla

MetProAlaPheAlaSerAlaPheGlnArgArgAlaGlyGlyValLeuValAlaSer

HisLeuGlnSerPheLeuGluValSerTyrArgValLeuArgHisLeuAlaGlnPro

ThrProLeuGlyProAlaSerSerLeuProGlnSerPheLeuLeuLysSerLeuGlu

GlnValArgLysIleGlnGlyAspGlyAlaAlaLeuGlnGluLysLeuCysAlaThr

TyrLysLeuCysHisProGluGluLeuValLeuLeuGlyHisSerLeuGlyIlePro

TrpAlaProLeuSerSerCysProSerGlnAlaLeuGlnLeuAlaGlyCysLeuSer

GlnLeuHisSerGlyLeuPheLeuTyrGlnGlyLeuLeuGlnAlaLeuGluGlyIle

SerProGluLeuGlyProThrLeuAspThrLeuGlnLeuAspValAlaAspPheAla

ThrThrIleTrpGlnGlnMetGluGluLeuGlyMetAlaProAlaLeuGlnPro

CSF). The activity of the multi-functional hematopoietic receptor agonist in these cell lines can be compared with hIL-3 or G-CSF alone or together. The bioactivity of examples of multi-functional hematopoietic receptor agonists of the present invention assayed in the BaF3/hG-CSF cell proliferation and TF1 cell proliferation assays is shown in Table 5 and Table 6. The bioactivity of the multi-functional hematopoietic receptor agonist is expressed as relative activity compared with a standard protein pMON13056 (WO 95/21254). The bioactivity of examples of multi-functional hematopoietic receptor agonists of the present invention assayed in the BaF3/c-mpl cell proliferation and TF1 cell proliferation assays is shown in Table 7 and Table 8.

EXAMPLE 87

Determination of the in vitro Activity of Multi-functional Hematopoietic Receptor Agonist Proteins The protein concentration of the multi-functional hematopoietic receptor agonist protein can be determined using a sandwich ELISA based on an affinity purified polyclonal antibody. Alternatively the protein concentration can be determined by amino acid composition analysis. The bioactivity of the multi-functional hematopoietic receptor agonist can be determined in a number of in vitro assays. For example a multi-functional hematopoietic receptor agonist which binds the hIL-3 receptor and G-CSF receptor can be assayed in cell proliferation assays using cell lines expressing the hIL-3 and/or G-CSF receptors. One such assay is the AML-193 cell proliferation assay. AML-193 cells respond to IL-3 and G-CSF which allows for the combined bioactivity of the IL-3/G-CSF multi-functional hematopoietic receptor agonist to be determined. Another such assay is the TF1 cell proliferation assay.

In addition other factor dependent cell lines, such as M-NFS-60 (ATCC. CRL 1838) or 32D which are murine IL-3 dependent cell line, may be used. The activity of IL-3 is species specific whereas G-CSF is not, therefore the bioactivity of the G-CSF component of the IL-3/G-CSF multi-functional hematopoietic receptor agonist can be determined independently. Cell lines, such as BHK or murine Baf/3, which do not express the receptor for a given ligand can be transfected with a plasmid containing a gene encoding the desired receptor. An example of such a cell line is BaF3 transfected with the hG-CSF receptor (BaF3/hG-

TABLE 5

CELL PROLIFERATIVE ACTIVITY
OF DUAL IL-3/G-CSF RECEPTOR AGONISTS

| pMON | BaF3/hG-CSF receptor cell proliferation assay relative activity* | TF1 cell proliferation assay relative activity* |
| --- | --- | --- |
| 13182 | 0.015 | 1.1 |
| 13183 | 0.02 | nd |
| 13184 | 0.01 | 0.3 |
| 13185 | 0.023 | 0.36 |
| 13186 | 0.36 | 0.45 |
| 13187 | 0.07 | 0.26 |
| 13188 | 0.64 | 1.3 |
| 13189 | 0.58 | 1.37 |
| 13190 | 0.045 | 1.2 |
| 13191 | 0.14 | 2.7 |
| 13192 | 0.09 | 2.2 |
| 13193 | 0.06 | 3.0 |
| 25190 | nd | nd |
| 25191 | 0.43 | 1.2 |
| 13194 | nd | nd |
| 13195 | 1.3 | 4.3 |

TABLE 5-continued

CELL PROLIFERATIVE ACTIVITY OF DUAL IL-3/G-CSF RECEPTOR AGONISTS

| pMON | BaF3/hG-CSF receptor cell proliferation assay relative activity* | TF1 cell proliferation assay relative activity* |
|---|---|---|
| 13196 | 0.66 | 0.5 |
| 13197 | 0.6 | 0.77 |
| 13198 | 0.6 | 0.5 |
| 13199 | nd | nd |
| 15982 | 0.7 | 1.9 |
| 15981 | 0.068 | 1.2 |
| 15965 | 0.7 | 0.82 |
| 15966 | 0.36 | 1.48 |
| 15967 | 0.62 | 1.37 | nd = not determined
*The bioactivity of the multi-functional hematopoietic receptor agonist is expressed as relative activity compared with a standard protein pMON13056. n = 3 or greater

TABLE 6

CELL PROLIFERATIVE ACTIVITY OF DUAL IL-3/G-CSF RECEPTOR AGONISTS

| pMON | BaF3/hG-CSF receptor cell proliferation assay relative activity | TF1 cell proliferation assay relative activity |
|---|---|---|
| 31104 | + | + |
| 31105 | + | + |
| 31106 | + | + |
| 31107 | nd | nd |
| 31108 | + | + |
| 31109 | + | + |
| 31110 | nd | nd |
| 31111 | nd | nd |
| 31112 | + | + |
| 31113 | + | + |
| 31114 | + | + |
| 31115 | + | + |
| 31116 | nd | nd |
| 31117 | nd | nd | nd = not determined
† The bioactivity (n = 1 or 2) of the multi-functional hematopoietic receptor agonist is expressed as relative activity compared with a standard protein pMON13056. "+" indicates that the molecule was comparable to pMON13056.

TABLE 7

CELL PROLIFERATION ACTIVITY

| pMON | Baf3/c-mpl receptor cell proliferation assay activity* | TF1 cell proliferation assay activity |
|---|---|---|
| 28505 | − | + |
| 28506 | − | + |
| 28507 | − | + |
| 28508 | − | + |
| 28509 | − | + |
| 28510 | − | + |
| 28511 | + | + |
| 28512 | + | + |
| 28513 | + | + |
| 28514 | + | + |
| 28519 | − | + |
| 28520 | − | + |
| 28521 | − | + |
| 28522 | − | + |
| 28523 | − | + |
| 28524 | − | + |
| 28525 | + | + |
| 28526 | + | + |
| 28533 | − | + |
| 28534 | − | + |
| 28535 | − | + |
| 28536 | − | + |
| 28537 | − | + |
| 28538 | − | + |
| 28539 | + | + |
| 28540 | + | + |
| 28541 | + | + |
| 28542 | + | + |
| 28543 | + | + |
| 28544 | + | + |
| 28545 | + | + |

*Activity measured in the Baf3 cell line transfected with the c-mpl receptor, relative to c-mpl ligand (1-153).
† Activity measured relative to pMON13056.

In a similar manner other factor dependent cell lines known to those skilled in the art can be used to measure the bioactivity of the desired multi-functional hematopoietic receptor agonist. The methylcellulose assay can be used to determine the effect of the multi-functional hematopoietic receptor agonists on the expansion of the hematopoietic progenitor cells and the pattern of the different types of hematopoietic colonies in vitro. The methylcellulose assay can provide an estimate of precursor frequency since one measures the frequency of progenitors per 100,000 input cells. Long term, stromal dependent cultures have been used to delineate primitive hematopoietic progenitors and stem cells. This assay can be used to determine whether the multi-functional hematopoietic receptor agonist stimulates the expansion of very primitive progenitors and/or stem cells. In addition, limiting dilution cultures can be performed which will indicate the frequency of primitive progenitors stimulated by the multi-functional hematopoietic receptor agonist.

TABLE 8

| pMON # | IL-3 agonist activity (AML cell proliferation assay) | c-mpl receptor agonist activity (Baf/3-c-mpl cell proliferation assay |
|---|---|---|
| 28505 | + | − |
| 28506 | + | − |
| 28507 | + | − |
| 28508 | + | − |
| 28509 | + | − |
| 28510 | + | − |
| 28511 | + | + |
| 28512 | + | + |
| 28513 | + | + |
| 28514 | + | + |
| 28515 | + | + |
| 28519 | + | − |
| 28520 | + | − |
| 28521 | + | − |
| 28522 | + | − |
| 28523 | + | − |
| 28524 | + | − |
| 28525 | + | + |

TABLE 8-continued

| pMON # | IL-3 agonist activity (AML cell proliferation assay) | c-mpl receptor agonist activity (Baf/3-c-mpl cell proliferation assay) |
|---|---|---|
| 28526 | + | + |
| 28527 | + | + |
| 28528 | + | + |
| 28529 | + | + |
| 28535 | + | − |
| 28539 | + | + |
| 28540 | + | + |
| 28541 | + | + |
| 28542 | + | + |
| 28545 | + | + |
| 28551 | + | + |
| 28571 | + | + |

EXAMPLE 88

G-CSF variants which contain single or multiple amino acid substitutions were made using PCR mutagenesis techniques as described in WO 94/12639 and WO 94/12638. These and other variants (i.e. amino acid substitutions, insertions or deletions and N-terminal or C-terminal extensions) could also be made, by one skilled in the art, using a variety of other methods including synthetic gene assembly or site-directed mutagenesis (see Taylor et al., *Nucl. Acids Res.*, 13: 7864–8785 [1985]; Kunkel et al., *Proc. Natl. Acad. Sci. USA*, 82: 488–492 [1985]; Sambrook et al., *Molecular Cloning: A Laboratory Manual*, 2nd ed., Cold Spring Harbor Laboratory Press, Cold Spring Harbor, N.Y., [1989], (WO 94/12639) and (WO 94/12638)). These substitutions can be made one at a time or in combination with other amino acid substitutions, and/or deletions, and/or insertions and/or extensions. After sequence verification of the changes, the plasmid DNA can be transfected into an appropriate mammalian cell, insect cell or bacterial strain such as *E. coli* for production. Known variants of G-CSF, which are active, include substitutions at positions 1 (Thr to Ser, Arg or Gly, 2 (Pro to Leu), 3 (Leu to Arg or Ser) and 17 (Cys to Ser) and deletions of amino acids 1–11 (Kuga et al. *Biochemicla and Biophysical Research Comm.* 159:103–111 (1989)). These G-CSF amino acid substitution variants can be used as the template to create the G-CSF receptor agonists in which a new N-terminus and new C-terminus are created. Examples of G-CSF amino acid substitution variants are shown in Table 9.

EXAMPLE 89

Bioactivity Determination of G-CSF Amino Acid Substitution Variants

The G-CSF amino acid substitution variants can be assayed for cell proliferation activity using the Baf/3 cell line transfected with the human G-CSF receptor. The bioactivity of examples of G-CSF amino acid substitution variants is shown in Table 9 relative to native human G-CSF. A "+" indicates a comparable activity to native and a "−" indicates significantly reduced or no measurable activity.

TABLE 9

CELL PROLIFERATION ACTIVITY OF G-CSF VARIANTS IN BAF3 CELL LINE TRANSFECTED WITH THE HUMAN G-CSF RECEPTOR

| aa position | native aa | mutant aa | activity * |
|---|---|---|---|
| 13 | Phe | Ser | + |
| 13 | Phe | His | + |
| 13 | Phe | Thr | + |
| 13 | Phe | Pro | + |
| 16 | Lys | Pro | + |
| 16 | Lys | Ser | + |
| 16 | Lys | Thr | + |
| 16 | Lys | His | + |
| 18 | Leu | Pro | + |
| 18 | Leu | Thr | + |
| 18 | Leu | His | + |
| 18 | Leu | Cys | + |
| 18 | Leu | Ile | + |
| 19 | Glu | Ala | − |
| 19 | Glu | Thr | − |
| 19 | Glu | Arg | − |
| 19 | Glu | Pro | − |
| 19 | Glu | Leu | − |
| 19 | Glu | Ser | − |
| 22 | Arg | Tyr | + |
| 22 | Arg | Ser | + |
| 22 | Arg | Ala | + |
| 22 | Arg | Thr | + |
| 24 | Ile | Pro | + |
| 24 | Ile | Leu | + |
| 24 | Ile | Tyr | + |
| 27 | Asp | Gly | + |
| 30 | Ala | Ile | + |
| 30 | Ala | Leu | + |
| 34 | Lys | Ser | + |
| 43 | His | Gly | + |
| 43 | His | Thr | + |
| 43 | His | Val | + |
| 43 | His | Lys | + |
| 43 | His | Trp | + |
| 43 | His | Ala | + |
| 43 | His | Arg | + |
| 43 | His | Cys | + |
| 43 | His | Leu | + |
| 44 | Pro | Arg | + |
| 44 | Pro | Asp | + |
| 44 | Pro | Val | + |
| 44 | Pro | Ala | + |
| 44 | Pro | His | + |
| 44 | Pro | Gln | + |
| 44 | Pro | Trp | + |
| 44 | Pro | Gly | + |
| 44 | Pro | Thr | + |
| 46 | Glu | Ala | + |
| 46 | Glu | Arg | + |
| 47 | Leu | Thr | + |
| 49 | Leu | Phe | + |
| 49 | Leu | Arg | + |
| 49 | Leu | Ser | + |
| 50 | Leu | His | + |
| 54 | Leu | His | + |
| 67 | Gln | Lys | + |
| 67 | Gln | Leu | + |
| 67 | Gln | Cys | + |
| 70 | Gln | Pro | + |
| 70 | Gln | Leu | + |
| 70 | Gln | Arg | + |

TABLE 9-continued

CELL PROLIFERATION ACTIVITY OF G-CSF VARIANTS IN BAF3 CELL LINE TRANSFECTED WITH THE HUMAN G-CSF RECEPTOR

| aa position | native aa | mutant aa | activity * |
|---|---|---|---|
| 70 | Gln | Ser | + |
| 104 | Asp | Gly | + |
| 104 | Asp | Val | + |
| 108 | Leu | Ala | + |
| 108 | Leu | Val | + |
| 108 | Leu | Arg | + |
| 108 | Leu | Gly | + |
| 108 | Leu | Trp | + |
| 108 | Leu | Gln | + |
| 115 | Thr | His | + |
| 115 | Thr | Leu | + |
| 115 | Thr | Ala | + |
| 144 | Phe | His | + |
| 144 | Phe | Arg | + |
| 144 | Phe | Pro | + |
| 144 | Phe | Leu | + |
| 144 | Phe | Glu | + |
| 146 | Arg | Gln | + |
| 147 | Arg | Gln | + |
| 156 | His | Asp | − |
| 156 | His | Ser | + |
| 156 | His | Gly | + |
| 159 | Ser | Arg | + |
| 159 | Ser | Thr | + |
| 159 | Ser | Tyr | + |
| 159 | Ser | Val | + |
| 159 | Ser | Gly | + |
| 162 | Glu | Gly | − |
| 162 | Glu | Trp | + |
| 162 | Glu | Leu | + |
| 163 | Val | Arg | + |
| 163 | Val | Ala | + |
| 163 | Val | Gly | + |
| 165 | Tyr | Cys | nd |
| 169 | Ser | Leu | + |
| 169 | Ser | Cys | + |
| 169 | Ser | Arg | + |
| 170 | His | Arg | + |
| 170 | His | Ser | + |

* activity relative to native hG-CSF
nd = not determined

Example 90

Cysteine Substitution Variants

The multi-functional receptor agonists may comprise sequence rearranged c-mpl receptor agonist, which also have the substitution of the cysteine residues at position 7 and/or 151 with an another amino acid, can be prepared by the methods described in Examples 1–89 and by other methods known to those skilled in the art. One such c-mpl receptor agonist has the breakpoint at 115/116 and alanine at positions 7 and 151. This c-mpl receptor agonist has the following amino acid:

MetAlaGlyArgThrThrAla-HisLysAspProAsnAlaIlePheLeuSerPheGlnHis LeuLeuArg-GlyLysValArgPheLeuMetLeuValG-lyGlySerThrLeuAlaValArg GluPheGlyGlyAsnMetAlaSer-ProAlaProProAlaAlaAspLeuArgValLeuSer LysLeuLeuAr-gAspSerHisValLeuHisSerArgLeuSerGlnCysProGluValHis ProLeuProThrProValLeuLeuProA-laValAspPheSerLeuGlyGluTrpLysThr GlnMetGlu-GluThrLysAlaGlnAspIleLeuGlyA-laValThrLeuLeuLeuGluGly ValMetAlaAlaArgGlyGlnLeuG-lyProThrCysLeuSerSerLeuLeuGlyGlnLeu SerGlyGlnV-alArgLeuLeuLeuGlyAlaLeuGln-SerLeuLeuGlyThrGlnLeuPro ProGln (SEQ ID NO:284), and is encoded by the following DNA sequence;

```
  1  ATGGCTGGCA GGACCACAGC TCACAAGGAT CCCAATGCCA TCTTCCTGAG   (SEQ ID NO:287)

51  CTTCCAACAC CTGCTCCGAG GAAAGGTGCG TTTCCTGATG CTTGTAGGAG

101  GGTCCACCCT CGCCGTCAGG GAATTCGGCG GCAACATGGC GTCTCCGGCG

151  CCGCCTGCTG CTGACCTCCG AGTCCTCAGT AAACTGCTTC GTGACTCCCA

201  TGTCCTTCAC AGCAGACTGA GCCAGTGCCC AGAGGTTCAC CCTTTGCCTA

251  CACCTGTCCT GCTGCCTGCT GTGGACTTTA GCTTGGGAGA ATGGAAAACC

301  CAGATGGAGG AGACCAAGGC ACAGGACATT CTGGGAGCAG TGACCCTTCT

351  GCTGGAGGGA GTGATGGCAG CACGGGGACA ACTGGGACCC ACTTGCCTCT
```

```
401 CATCCCTCCT GGGGCAGCTT TCTGGACAGG TCCGTCTCCT CCTTGGGGCC

451 CTGCAGAGCC TCCTTGGAAC CCAGCTTCCT CCACAG.
```

Another c-mpl receptor agonist has the breakpoint at 81/82 and alanine at positions 7 and 151. This c-mpl receptor agonist has the following amino acid; MetAlaGlyProThrCysLeuSerSer-LeuLeuGlyGlnLeuSerGlyGlnValArgLeu LeuLeuGlyAla-LeuGlnSerLeuLeuGlyThrGlnLeuProProGlnGlyArgThrThr AlaHisLysAspProAsnAlaIlePh-eLeuSerPheGlnHisLeuLeuArgGlyLysVal ArgPheLeu-MetLeuValGlyGlySerThrLeuAla-ValArgGluPheGlyGlyAsnMet AlaSerProAlaProProAlaAlaAs-pLeuArgValLeuSerLysLeuLeuArgAspSer HisvalLeu-HisSerArgLeuSerGlnCysProGlu-ValHisProLeuProThrProVal LeuLeuProAlaValAspPheSerLeuG-lyGluTrpLysThrGlnMetGluGluThrLys AlaGlnAspIleLeuG-lyAlaValThrLeuLeuLeuGluGlyValMetAlaAlaArgGly GlnLeu, (SEQ ID NO:285), and is encoded by the following DNA sequence;

TABLE 10

| plasmid designation | breakpoint | gene sequence | protein sequence |
|---|---|---|---|
| pMON16017 | 2–3 | SEQ ID NO:294 | SEQ ID NO:306 |
| pMON16018 | 10–11 | SEQ ID NO:288 | SEQ ID NO:300 |
| pMON16019 | 12–13 | SEQ ID NO:291 | SEQ ID NO:303 |
| pMON16021 | 48–49 | SEQ ID NO:295 | SEQ ID NO:307 |
| pMON16022 | 59–60 | SEQ ID NO:296 | SEQ ID NO:308 |
| pMON16023 | 66–67 | SEQ ID NO:297 | SEQ ID NO:309 |
| pMON16024 | 68–69 | SEQ ID NO:298 | SEQ ID NO:310 |
| pMON16025 | 122–123 | SEQ ID NO:289 | SEQ ID NO:301 |
| pMON16028 | 158–159 | SEQ ID NO:292 | SEQ ID NO:304 |
| pMON16025 | 70–71 | SEQ ID NO:299 | SEQ ID NO:311 |
| pMON16027 | 124–125 | SEQ ID NO:290 | SEQ ID NO:302 |
| pMON16020 | 18–19 | SEQ ID NO:293 | SEQ ID NO:305 |
| pMON16029 | 169–170 | SEQ ID NO:313 | SEQ ID NO:312 |

Without further elaboration, it is believed that one skilled in the art can, using the preceding description, utilize the

```
  1 ATGGCTGGAC CCACTTGCCT CTCATCCCTC CTGGGGCAGC TTTCTGGACA    (SEQ ID NO:286)

51 GGTCCGTCTC CTCCTTGGGG CCCTGCAGAG CCTCCTTGGA ACCCAGCTTC

101 CTCCACAGGG CAGGACCACA GCTCACAAGG ATCCCAATGC CATCTTCCTG

151 AGCTTCCAAC ACCTGCTCCG AGGAAAGGTG CGTTTCCTGA TGCTTGTAGG

201 AGGGTCCACC CTCGCCGTCA GGGAATTCGG CGGCAACATG GCGTCTCCGG

251 CGCCGCCTGC TGCTGACCTC CGAGTCCTCA GTAAACTGCT TCGTGACTCC

301 CATGTCCTTC ACAGCAGACT GAGCCAGTGC CCAGAGGTTC ACCCTTTGCC

351 TACACCTGTC CTGCTGCCTG CTGTGGACTT TAGCTTGGGA GAATGGAAAA

401 CCCAGATGGA GGAGACCAAG GCACAGGACA TTCTGGGAGC AGTGACCCTT

451 CTGCTGGAGG GAGTGATGGC AGCACGGGGA CAACTG
```

EXAMPLES 91–103

The plasmids in Table 10 contain genes encoding multifunctional hematopoietic receptor agonists comprising a sequence rearranged G-CSF receptor agonists that were made by the method of Horlich et al (*Protein Eng.* 5:427

SEQUENCE LISTING (313 sequences)

SEQ ID NO: 1 - protein, 174 aa
  Modified-site 1: /note= "Xaa at position 1 is Thr, Ser, Arg, Tyr or Gly;"
  Modified-site 2: /note= "Xaa at position 2 is Pro or Leu;"
  Modified-site 3: /note= "Xaa at position 3 is Leu, Arg, Tyr or Ser;"
  Modified-site 13: /note= "Xaa at position 13 is Phe, Ser, His, Thr or Pro;"
  Modified-site 16: /note= "Xaa at position 16 is Lys, Pro, Ser, thr or His;"
  Modified-site 17: /note= "Xaa at position 17 is Cys, Ser, Gly, Ala, Ile, Tyr or Arg;"
  Modified-site 18: /note= "Xaa at position 18 is Leu, Thr, Pro, His, Ile or Cys;"
  Modified-site 22: /note= "Xaa at position 22 is Arg, Tyr, Ser, Thr or Ala;"
  Modified-site 24: /note= "Xaa at position 24 is Ile, Pro, Tyr or Leu;"
  Modified-site 27: /note= "Xaa at position 27 is Asp, or Gly;"
  Modified-site 30: /note= "Xaa at position 30 is Ala, Ile, Leu or Gly;"
  Modified-site 34: /note= "Xaa at position 34 is Lys or Ser;"
  Modified-site 36: /note= "Xaa at position 36 is Cys or Ser;"
  Modified-site 42: /note= "Xaa at position 42 is Cys or Ser;"
  Modified-site 43: /note= "Xaa at position 43 is His, Thr, Gly, Val, Lys, Trp, Ala, Arg, Cys, or Leu;"
  Modified-site 44: /note= "Xaa at position 44 is Pro, Gly, Arg, Asp, Val, Ala, His, Trp, Gln, or Thr;"
  Modified-site 46: /note= "Xaa at position 46 is Glu, Arg, Phe, Arg, Ile or Ala;"
  Modified-site 47: /note= "Xaa at position 47 is Leu or Thr;"
  Modified-site 49: /note= "Xaa at position 49 is Leu, Phe, Arg or Ser;"
  Modified-site 50: /note= "Xaa at position 50 is Leu, Ile, His, Pro or Tyr;"
  Modified-site 54: /note= "Xaa at position 54 is Leu or His;"
  Modified-site 64: /note= "Xaa at position 64 is Cys or Ser;"
  Modified-site 67: /note= "Xaa at position 67 is Gln, Lys, Leu or Cys;"
  Modified-site 70: /note= "Xaa at position 70 is Gln, Pro, Leu, Arg or Ser;"
  Modified-site 74: /note= "Xaa at position 74 is Cys or Ser;"
  Modified-site 104: /note= "Xaa at position 104 is Asp, Gly or Val;"
  Modified-site 108: /note= "Xaa at position 108 is Leu, Ala, Val, Arg, Trp, Gln or Gly;"
  Modified-site 115: /note= "Xaa at position 115 is Thr, His, Leu or Ala;"
  Modified-site 120: /note= "Xaa at position 120 is Gln, Gly, Arg, Lys or His"
  Modified-site 123: /note= "Xaa at position 123 is Glu, Arg, Phe or Thr"
  Modified-site 144: /note= "Xaa at position 144 is Phe, His, Arg, Pro, Leu, Gln or Glu;"
  Modified-site 146: /note= "Xaa at position146 is Arg or Gln;"
  Modified-site 147: /note= "Xaa ap position 147 is Arg or Gln;"
  Modified-site 156: /note= "Xaa at position 156 is His, Gly or Ser;"
  Modified-site 159: /note= "Xaa at position 159 is Ser, Arg, Thr, Tyr, Val or Gly;"
  Modified-site 162: /note= "Xaa at position 162 is Glu, Leu, Gly or Trp;"
  Modified-site 163: /note= "Xaa at position 163 is Val, Gly, Arg or Ala;"
  Modified-site 169: /note= "Xaa at position 169 is Arg, Ser, Leu, Arg or Cys;"
  Modified-site 170: /note= "Xaa at position 170 is His, Arg or Ser;"
XXXGPASSLPQSXLLXXXEQVXKXQGXGAXLQEXLXATYKLXXXEXXVXXGHSXGIPWAPLSSXPSXALXLAGXLSQLHSGLFLYQGLLQALEGISPELGPTLXTLQXDVADFAXTIWQQMEXXGMAPALQPTQGAMPAFASAXQXXAGGVLVASXLQXFLXXSYRVLXXLAQP

SEQ ID NO: 2 - protein, 133 aa
  Modified-site 17: /note= "Xaa at position 17 is Ser, Lys, Gly, Asp, Met, Gln, or Arg;"
  Modified-site 18: /note= "Xaa at position 18 is Asn, His, Leu, Ile, Phe, Arg, or Gln;"
  Modified-site 19: /note= "Xaa at position 19 is Met, Phe, Ile, Arg, Gly, Ala, or Cys;"
  Modified-site 20: /note= "Xaa at position 20 is Ile, Cys, Gln, Glu, Arg, Pro, or Ala;"
  Modified-site 21: /note= "Xaa at position 21 is Asp, Phe, Lys, Arg, Ala, Gly, Glu, Gln, Asn, Thr, Ser or Val;"
  Modified-site 22: /note= "Xaa at position 22 is Glu, Trp, Pro, Ser, Ala, His, Asp, Asn, Gln, Leu, Val or Gly;"
  Modified-site 23: /note= "Xaa at position 23 is Ile, Val, Ala, Gly, Trp, Lys, Phe, Leu, Ser, or Arg;"
  Modified-site 24: /note= "Xaa at position 24 is Ile, Gly, Val, Arg, Ser, Phe, Leu;"
  Modified-site 25: /note= "Xaa at position 25 is Thr, His, Gly, Gln, Arg, Pro, or Ala;"
  Modified-site 26: /note= "Xaa at position 26 is His, Thr, Phe, Gly, Arg, Ala, Trp;"
  Modified-site 27: /note= "Xaa at position 27 is Leu, Gly, Arg, Thr, Ser, or Ala;"
  Modified-site 28: /note= "Xaa at position 28 is Lys, Arg, Leu, Gln, Gly, Pro, Val or Trp;"
  Modified-site 29: /note= "Xaa at position 29 is Gln, Asn, Leu, Pro, Arg, or Val;"
  Modified-site 30: /note= "Xaa at position 30 is Pro, His, Thr, Gly, Asp, Gln, Ser, Leu, or L..."
  Modified-site 31: /note= "Xaa at position 31 is Pro, Asp, Gly, Ala, Arg, Leu, or Gln;"
  Modified-site 32: /note= "Xaa at position 32 is Leu, Val, Arg, Gln, Asn, Gly, Ala, or Glu;"
  Modified-site 33: /note= "Xaa at position 33 is Pro, Leu, Gln, Ala, Thr, or Glu;"
  Modified-site 34: /note= "Xaa at position 34 is Leu, Val, Gly, Ser, Lys, Glu, Gln, Thr, Arg, Ala, Phe, Ile or Met;"
  Modified-site 35: /note= "Xaa at position 35 is Leu, Ala, Gly, Asn, Pro, Gln, or Val;"
  Modified-site 36: /note= "Xaa at position 36 is Asp, Leu, or Val;"
  Modified-site 37: /note= "Xaa at position 37 is Phe, Ser, Pro, Trp, or Ile;"
  Modified-site 38: /note= "Xaa at position 38 is Asn, or Ala;"
  Modified-site 40: /note= "Xaa at position 40 is Leu, Trp, or Arg;"
  Modified-site 41: /note= "Xaa at position 41 is Asn, Cys, Arg, Leu, His, Met, or pro;"
  Modified-site 42: /note= "Xaa at position 42 is Gly, Asp, Ser, Cys, Asn, Lys, Thr, Leu, Val, Glu, Phe, Tyr, Ile, Met or Ala;"
  Modified-site 43: /note= "Xaa at position 43 is Glu, Asn, Tyr, Leu, Phe, Asp, Ala, Cys, Gln, Arg, Thr, Gly, or Ser;"
  Modified-site 44: /note= "Xaa at position 44 is Asp, Ser, Leu, Arg, Lys, Thr, Met, Trp, Glu, Asn, Gln, Ala or Pro;"
  Modified-site 45: /note= "Xaa at position 45 is Gln, Pro, Phe, Val, Met, Leu, Thr, Lys, Trp, Asp, Asn, Arg, Ser, Ala, Ile, Glu or His;"
  Modified-site 46: /note= "Xaa at position 46 is Asp, Phe, Ser, Thr, Cys, Glu, Asn, Gln, Lys, His, Ala, Tyr, Ile, Val or Gly;"
  Modified-site 47: /note= "Xaa at position 47 is Ile, Gly, Val, Ser, Arg, Pro, or His;"
  Modified-site 48: /note= "Xaa at position 48 is Leu, Ser, Cys, Arg, Ile, His, Phe, Glu, Lys, Thr, Ala, Met, Val or Asn;"
  Modified-site 49: /note= "Xaa at position 49 is Met, Arg, Ala, Gly, Pro, Asn, His, or Asp;"
  Modified-site 50: /note= "Xaa at position 50 is Glu, Leu, Thr, Asp, Tyr, Lys, Asn, Ser, Ala, Ile, Val, His, Phe, Met or Gln;"
  Modified-site 51: /note= "Xaa at position 51 is Asn, Arg, Met, Pro, Ser, Thr, or his;"
  Modified-site 52: /note= "Xaa at position 52 is Asn, His, Arg, Leu, Gly, Ser, or Thr;"
  Modified-site 53: /note= "Xaa at position 53 is Leu, Thr, Ala, Gly, Glu, Pro, Lys, Ser, or M..."
  Modified-site 54: /note= "Xaa at position 54 is Arg, Asp, Ile, Ser, Val, Thr, Gln, Asn, Lys, His, Ala or Leu;"
  Modified-site 55: /note= "Xaa at position 55 is Arg, Thr, Val, Ser, Leu, or Gly;"
  Modified-site 56: /note= "Xaa at position 56 is Pro, Gly, Cys, Ser, Gln, Glu, Arg, His, Thr, Ala, Tyr, Phe, Leu, Val or Lys;"
  Modified-site 57: /note= "Xaa at position 57 is Asn or Gly;"
  Modified-site 58: /note= "Xaa at position 58 is Leu, Ser, Asp, Arg, Gln, Val, or Cys;"
  Modified-site 59: /note= "Xaa at position 59 is Glu, Tyr, His, Leu, Pro, or Arg;"
  Modified-site 60: /note= "Xaa at position 60 is Ala, Ser, Pro, Tyr, Asn, or Thr;"
  Modified-site 61: /note= "Xaa at position 61 is Phe, Asn, Glu, Pro, Lys, Arg, or Ser;"
  Modified-site 62: /note= "Xaa at position 62 is Asn, His, Val, Arg, Pro, Thr, Asp, or Ile;"
  Modified-site 63: /note= "Xaa at position 63 is Arg, Tyr, Trp, Lys, Ser, His, Pro, or Val;"
  Modified-site 64: /note= "Xaa at position 64 is Ala, Asn, Pro, Ser, or Lys;"
  Modified-site 65: /note= "Xaa at position 65 is Val, Thr, Pro, His, Leu, Phe, or Ser;"
  Modified-site 66: /note= "Xaa at position 66 is Lys, Ile, Arg, Val, Asn, Glu, or Ser;"
  Modified-site 67: /note= "Xaa at postion 67 is Ser, Ala, Phe, Val, Gly, Asn, Ile, Pro, or His;"
  Modified-site 68: /note= "Xaa at position 68 is Leu, Val, Trp, Ser, Ile, Phe, Thr, or His;"
  Modified-site 69: /note= "Xaa at position 69 is Gln, Ala, Pro, Thr, Glu, Arg, Trp, Gly, or L..."
  Modified-site 70: /note= "Xaa at position 70 is Asn, Leu, Val, Trp, pro, or Ala;"
  Modified-site 71: /note= "Xaa at position 71 is Ala, Met, Leu, Pro, Arg, Glu, Thr, Gln, Trp, or Asn;"
  Modified-site 72: /note= "Xaa at position 72 is Ser, Glu, Met, Ala, His, Asn, Arg, or Asp;"
  Modified-site 73: /note= "Xaa at position 73 is Ala, Glu, Asp, Leu, Ser, Gly, Thr, or Arg;"
  Modified-site 74: /note= "Xaa at position 74 is Ile, Met, Thr, Pro, Arg, Gly, Ala;"
  Modified-site 75: /note= "Xaa at position 75 is Glu, Lys, Gly, Asp, Pro, Trp, Arg, Ser, Gln, or Leu;"
  Modified-site 76: /note= "Xaa at position 76 is Ser, Val, Ala, Asn, Trp, Glu, Pro, Gly, or A..."
  Modified-site 77: /note= "Xaa at position 77 is Ile, Ser, Arg, Thr, or Leu;"
  Modified-site 78: /note= "Xaa at position 78 is Leu, Ala, Ser, Glu, Phe, Gly, or Arg;"
  Modified-site 79: /note= "Xaa at position 79 is Lys, Thr, Asn, Met, Arg, Ile, Gly, or Asp;"
  Modified-site 80: /note= "Xaa position at 80 is Asn, Trp, Val, Gly, Thr, Leu, Glu, or Arg;"
  Modified-site 81: /note= "Xaa at position 81 is Leu, Gln, Gly, Ala, Trp, Arg, Val, or Lys;"
  Modified-site 82: /note= "Xaa at position 82 is Leu, Gln, Lys, Trp, Arg, Asp, Glu, Asn, His, Thr, Ser, Ala, Tyr, Phe, Ile, Met or Val;"
  Modified-site 83: /note= "Xaa at position 83 is Pro, Ala, Thr, Trp, Arg, or Met;"
  Modified-site 84: /note= "Xaa at position 84 is Cys, Glu, Gly, Arg, Met, or Val;"
  Modified-site 85: /note= "Xaa at position 85 is Leu, Asn, Val, or Gln;"
  Modified-site 86: /note= "Xaa at position 86 is Pro, Cys, Arg, Ala, or Lys;"
  Modified-site 87: /note= "Xaa at position 87 is Leu, Ser, Trp, or Gly;"
  Modified-site 88: /note= "Xaa at position 88 is Ala, Lys, Arg, Val, or Trp;"
  Modified-site 89: /note= "Xaa at position 89 is Thr, Asp, Cys, Leu, Val, Glu, His, Asn, or S..."
  Modified-site 90: /note= "Xaa at position 90 is Ala, Pro, Ser, Thr, Gly, Asp, Ile, or ,Met;"
  Modified-site 91: /note= "Xaa at position 91 is Ala, Pro, Ser, Thr, Phe, Leu, Asp, or His;"
  Modified-site 92: /note= "Xaa at position 92 is Pro, Phe, Arg, Ser, Lys, His, Ala, Gly, Ile or Leu;"
  Modified-site 93: /note= "Xaa at position 93 is Thr, Asp, Ser, Asn, Pro, Ala, Leu, or Arg;"
  Modified-site 94: /note= "Xaa at position 94 is Arg, Ile, Ser, Glu, Leu, Val, Gln, Lys, His, Ala, or Pro;"
  Modified-site 95: /note= "Xaa at position 95 is His, Gln, Pro, Arg, Val, Leu, Gly, Thr, Asn, Lys, Ser, Ala, Trp, Phe, Ile, or Tyr;"
  Modified-site 96: /note= "Xaa at position 96 is Pro, Lys, Tyr, Gly, Ile, or Thr;"
  Modified-site 97: /note= "Xaa at position 97 is Ile, Val, Lys, Ala, or Asn;"
  Modified-site 98: /note= "Xaa at position 98 is His, Ile, Asn, Leu, Asp, Ala, Thr, Glu, Gln, Ser, Phe, Met, Val, Lys, Arg, Tyr, or Pro;"
  Modified-site 99: /note= "Xaa at position 99 is Ile, Leu, Arg, Asp, Val, Pro, Gln, Gly, Ser, Phe, or His;"
  Modified-site 100: /note= "Xaa at position 100 is Lys, Tyr, Leu, His, Arg, Ile, Ser, Gln, or ..."
  Modified-site 101: /note= "Xaa at position is Asp, Pro, Met, Lys, His, Thr, Val, Tyr, Glu, Asn, Ser, Ala, Gly, Ile, Leu, or Gln;"
  Modified-site 102: /note= "Xaa at position 102 is Gly, Leu, Glu, Lys, Ser, Tyr, or Pro;"
  Modified-site 103: /note= "Xaa at position 103 is Asp, or Ser;"
  Modified-site 104: /note= "Xaa at position 104 is Trp, Val, Cys, Tyr, Thr, Met, Pro, Leu, Gln, Lys, Ala, Phe, or Gly;"
  Modified-site 105: /note= "Xaa at position 105 is Asn, Pro, Ala, Phe, Ser, Trp, Gln, Tyr, Leu, Lys, Ile, Asp, or His;"
  Modified-site 106: /note= "Xaa at position 106 is Glu, Ser, Ala, Lys, Thr, Ile, Gly, or Pro;"
  Modified-site 108: /note= "Xaa at position 108 is Arg, Lys, Asp, Leu, Thr, Ile, Gln, His, Ser, Ala or Pro;"
  Modified-site 109: /note= "Xaa at position 109 is Arg, Thr, Pro, Glu, Tyr, Leu, Ser, or Gly;"
  Modified-site 110: /note= "Xaa at position 110 is Lys, Ala, Asn, Thr, Leu, Arg, Gln, His, Glu, Ser, or Trp;"
  Modified-site 111: /note= "Xaa at position 111 is Leu, Ile, Arg, Asp, or Met;"
  Modified-site 112: /note= "Xaa at position 112 is Thr, Val, Gln, Tyr, Glu, His, Ser, or Phe;"
  Modified-site 113: /note= "Xaa at position 113 is Phe, Ser, Cys, His, Gly, Trp, Tyr, Asp, Lys, Leu, Ile, Val or Asn;"
  Modified-site 114: /note= "Xaa at position 114 is Tyr, Cys, His, Ser, Trp, Arg, or Leu;"
  Modified-site 115: /note= "Xaa at position 115 is Leu, Asn, Val, Pro, Arg, Ala, His, Thr, Trp, or Met;"
  Modified-site 116: /note= "Xaa at position 116 is Lys, Leu, Pro, Thr, Met, Asp, Val, Glu, Arg, Trp, Ser, Asn, His, Ala, Tyr, Phe, Gln, or Ile;"
  Modified-site 117: /note= "Xaa at position 117 is Thr, Ser, Asn, Ile, Trp, Lys, or Pro;"
  Modified-site 118: /note= "Xaa at position 118 is Leu, Ser, Pro, Ala, Glu, Cys, Asp, or Tyr;"
  Modified-site 119: /note= "Xaa at position 119 is Glu, Ser, Lys, Pro, leu, Thr, Tyr, or Arg;"
  Modified-site 120: /note= "Xaa at position 120 is Asn, Ala, Pro, Leu, His, Val, or Gln;"
  Modified-site 121: /note= "Xaa at position 121 is Ala, Ser, Ile, Asn, Pro, Lys, Asp, or Gly;"
  Modified-site 122: /note= "Xaa at position 122 is Gln, Ser, Met, Trp, Arg, Phe, Pro, His, Ile, Tyr, or Cys;"
  Modified-site 123: /note= "Xaa at position 123 is Ala, Met, Glu, His, Ser, Pro, Tyr, or Leu;"
APMTQTTSLKTSWVNCXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXFXXXXXXXXXXXXXXXXQQTTLSLAIF

SEQ ID NO: 3 - protein, 332 aa
  Modified-site 112: /note= "position 112 is deleted or Leu, Ala, Val, Ile, Pro, Phe, Trp, or M..."
  Modified-site 113: /note= "position 113 is deleted or Pro, Phe, Ala, Leu, Ile, Trp, or Met"
  Modified-site 114: /note= "position 114 is deleted or Pro, Phe, Ala, Val, Leu, Ile, Trp or Met"
  Modified-site 115: /note= "position 115 is deleted or Gln, Gly, Ser, Thr, Tyr or Asn"
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQXXXXGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 4 - protein, 5 aa
GYSRN

SEQ ID NO: 5 - protein, 3 aa
  Peptide 1: /note= "where x=(glyglyglyglyser)n and where n is an interger"
XAA

SEQ ID NO: 6 - protein, 3 aa
  Peptide 1
  Peptide 1: /note= "where Xaa =(glyglyglyglyglyser)n and where n is an integer"
XAA

SEQ ID NO: 7 - protein, 3 aa
  Peptide 1: /note= "where xaa = (gly(n)ser)m and where n is an integer and m is an int..."
XAA

SEQ ID NO: 8 - protein, 3 aa
  Peptide 1: /note= "where Xaa=(alaglyser)n and where n is an integer"
XAA

SEQ ID NO: 9 - protein, 36 aa
GGGSGGGSGGGSEGGGSEGGGSEGGGSEGGGSGGGS

SEQ ID NO: 10 - protein, 24 aa
ISEPSGPISTINPSPPSKESHKSP

SEQ ID NO: 11 - protein, 28 aa
IEGRISEPSGPISTINPSPPSKESHKSP

SEQ ID NO: 12 - protein, 4 aa
GGGS

SEQ ID NO: 13 - DNA (other nucleic acid), 45 bp; single-stranded, linear
  description: /desc = "DNA (synthetic)"
acgtccatggcntcnccngcnccncctgcttgtgcactccgagtc

SEQ ID NO: 14 - DNA (other nucleic acid), 30 bp; single-stranded, linear
  description: /desc = "DNA (synthetic)"
atgcacgaattccctgacgcagagggtgga

SEQ ID NO: 15 - DNA (other nucleic acid), 33 bp; single-stranded, linear
  description: /desc = "DNA (synthetic)"
tgacaagcttacctgacgcagagggtggaccct

SEQ ID NO: 16 - DNA (other nucleic acid), 10 bp; single-stranded, linear
  description: /desc = "DNA (synthetic)"
aattcggcaa

SEQ ID NO: 17 - DNA (other nucleic acid), 10 bp; single-stranded, linear
  description: /desc = "DNA (synthetic)"
catgttgccg

SEQ ID NO: 18 - DNA (other nucleic acid), 13 bp; single-stranded, linear
  description: /desc = "DNA (synthetic)"
aattcggcggcaa

SEQ ID NO: 19 - DNA (other nucleic acid), 13 bp; single-stranded, linear
  description: /desc = "DNA (synthetic)"
catgttgccgccg

SEQ ID NO: 20 - DNA (other nucleic acid), 22 bp; single-stranded, linear
  description: /desc = "DNA (synthetic)"
aattcggcggcaacggcggcaa

SEQ ID NO: 21 - DNA (other nucleic acid), 22 bp; single-stranded, linear
  description: /desc = "DNA (synthetic)"
catgttgccgccgttgccgccg

SEQ ID NO: 22 - DNA (other nucleic acid), 27 bp; single-stranded, linear
  description: /desc = "DNA (synthetic)"
cgatccatggaggttcaccctttgcct

SEQ ID NO: 23 - DNA (other nucleic acid), 29 bp; single-stranded, linear
  description: /desc = "DNA (synthetic)"
gatcaagcttatgggcactggctcagtct

SEQ ID NO: 24 - DNA (other nucleic acid), 27 bp; single-stranded, linear
  description: /desc = "DNA (synthetic)"
cgatacatgttgcctacacctgtcctg

SEQ ID NO: 25 - DNA (other nucleic acid), 29 bp; single-stranded, linear
  description: /desc = "DNA (synthetic)"
gatcaagcttaagggtgaacctctgggca

SEQ ID NO: 26 - DNA (other nucleic acid), 27 bp; single-stranded, linear
  description: /desc = "DNA (synthetic)"
cgatccatggtcctgctgcctgctgtg

SEQ ID NO: 27 - DNA (other nucleic acid), 29 bp; single-stranded, linear
  description: /desc = "DNA (synthetic)"
gatcaagcttaaggtgtaggcaaagggtg

SEQ ID NO: 28 - DNA (other nucleic acid), 30 bp; single-stranded, linear
  description: /desc = "DNA (synthetic)"
cgatccatggctgtggactttagcttggga

SEQ ID NO: 29 - DNA (other nucleic acid), 29 bp; single-stranded, linear
  description: /desc = "DNA (synthetic)"
gatcaagcttaaggcagcaggacaggtgt

SEQ ID NO: 30 - DNA (other nucleic acid), 27 bp; single-stranded, linear
  description: /desc = "DNA (synthetic)"
cgatccatggactttagcttgggagaa

SEQ ID NO: 31 - DNA (other nucleic acid), 29 bp; single-stranded, linear
  description: /desc = "DNA (synthetic)"
gatcaagcttacacagcaggcagcaggac

SEQ ID NO: 32 - DNA (other nucleic acid), 27 bp; single-stranded, linear
  description: /desc = "DNA (synthetic)"
cgatccatgggagaatggaaaacccag

SEQ ID NO: 33 - DNA (other nucleic acid), 29 bp; single-stranded, linear
  description: /desc = "DNA (synthetic)"
gatcaagcttacaagctaaagtccacagc

SEQ ID NO: 34 - DNA (other nucleic acid), 27 bp; single-stranded, linear
  description: /desc = "DNA (synthetic)"
cgatccatgggacccacttgcctctca

SEQ ID NO: 35 - DNA (other nucleic acid), 29 bp; single-stranded, linear
  description: /desc = "DNA (synthetic)"
gatcaagcttacagttgtccccgtgctgc

SEQ ID NO: 36 - DNA (other nucleic acid), 27 bp; single-stranded, linear
  description: /desc = "DNA (synthetic)"
cagtccatgggaacccagcttcctcca

SEQ ID NO: 37 - DNA (other nucleic acid), 29 bp; single-stranded, linear
  description: /desc = "DNA (synthetic)"
gatcaagcttaaaggaggctctgcagggc

SEQ ID NO: 38 - DNA (other nucleic acid), 27 bp; single-stranded, linear
  description: /desc = "DNA (synthetic)"
cgatccatgggcaggaccacagctcac

SEQ ID NO: 39 - DNA (other nucleic acid), 30 bp; single-stranded, linear
  description: /desc = "DNA (synthetic)"
gatcaagcttactgtggaggaagctgggtt

SEQ ID NO: 40 - DNA (other nucleic acid), 30 bp; single-stranded, linear
  description: /desc = "DNA (synthetic)"
cgatccatggctcacaaggatcccaatgcc

SEQ ID NO: 41 - DNA (other nucleic acid), 29 bp; single-stranded, linear
  description: /desc = "DNA (synthetic)"
gatcaagcttatgtggtcctgcgctgtgg

SEQ ID NO: 42 - DNA (other nucleic acid), 30 bp; single-stranded, linear
  description: /desc = "DNA (synthetic)"
cgatccatggatcccaatgccatcttcctg

SEQ ID NO: 43 - DNA (other nucleic acid), 29 bp; single-stranded, linear
  description: /desc = "DNA (synthetic)"
gatcaagcttacttgtgagctgtggtcct

SEQ ID NO: 44 - DNA (other nucleic acid), 30 bp; single-stranded, linear
  description: /desc = "DNA (synthetic)"
cgatccatggccatcttcctgagcttccaa

SEQ ID NO: 45 - DNA (other nucleic acid), 32 bp; single-stranded, linear
  description: /desc = "DNA (synthetic)"
gatcaagcttaattgggatccttgtgagctgt

SEQ ID NO: 46 - DNA (other nucleic acid), 83 bp; unknown-stranded, unknown
  description: /desc = "SYNTHETIC"
aattccgtcgtaaactgaccttctatctgaaaaccttggagaacgcgcaggctcaacagtacgtagagggcggtggaggctcc

SEQ ID NO: 47 - DNA (other nucleic acid), 83 bp; single-stranded, linear
  description: /desc = "DNA (synthetic)"
ccggggagcctccaccgccctctacgtactgttgagcctgcgcgttctccaaggttttcagatagaaggtcagtttacgacgg

SEQ ID NO: 48 - DNA (other nucleic acid), 59 bp; single-stranded, linear
  description: /desc = "DNA (synthetic)"
gttacccttgagcaagcgcaggaacaacagggtggtggctctaactgctctataatgat

SEQ ID NO: 49 - DNA (other nucleic acid), 56 bp; single-stranded, linear
  description: /desc = "DNA (synthetic)"
cgatcattatagagcagttagagccaccaccctgttgttcctgcgcttgctcaagg

SEQ ID NO: 50 - DNA (other nucleic acid), 80 bp; single-stranded, linear
  description: /desc = "DNA (synthetic)"
gttacccttgagcaagcgcaggaacaacagggtggtggctctggcggtggcagcggcggcggttctaactgctctataat

SEQ ID NO: 51 - DNA (other nucleic acid), 80 bp; single-stranded, linear
  description: /desc = "DNA (synthetic)"
cgatcattatagagcagttagaaccgccgccgctgccaccgccagagccaccaccctgttgttcctgcgcttgctcaagg

SEQ ID NO: 52 - DNA (other nucleic acid), 30 bp; single-stranded, linear
  description: /desc = "DNA (synthetic)"
gatcgaccatggctctggacccgaacaacc

SEQ ID NO: 53 - DNA (other nucleic acid), 28 bp; single-stranded, linear
  description: /desc = "DNA (synthetic)"
ctcgattacgtacaaaggtgcaggtggt

SEQ ID NO: 54 - DNA (other nucleic acid), 32 bp; single-stranded, linear
  description: /desc = "DNA (synthetic)"
gatcgaccatggctaatgcatcaggtattgag

SEQ ID NO: 55 - DNA (other nucleic acid), 28 bp; single-stranded, linear
  description: /desc = "DNA (synthetic)"
ctcgattacgtattctaagttcttgaca

SEQ ID NO: 56 - DNA (other nucleic acid), 32 bp; single-stranded, linear
  description: /desc = "DNA (synthetic)"
gatcgaccatggctgcaccctctcgacatcca

SEQ ID NO: 57 - DNA (other nucleic acid), 28 bp; single-stranded, linear
  description: /desc = "DNA (synthetic)"
ctcgattacgtaggccgtggcagagggc

SEQ ID NO: 58 - DNA (other nucleic acid), 32 bp; single-stranded, linear
  description: /desc = "DNA (synthetic)"
gatcgaccatggctgcaggtgactggcaagaa

SEQ ID NO: 59 - DNA (other nucleic acid), 28 bp; single-stranded, linear
  description: /desc = "DNA (synthetic)"
ctcgattacgtacttgatgatgattgga

SEQ ID NO: 60 - DNA (other nucleic acid), 54 bp; single-stranded, linear
  description: /desc = "DNA (synthetic)"
gctctgagagccgccagagccgccagagggctgcgcaaggtggcgtagaacgcg

SEQ ID NO: 61 - DNA (other nucleic acid), 54 bp; single-stranded, linear
  description: /desc = "DNA (synthetic)"
cagccctctggcggctctggcggctctcagagcttcctgctcaagtctttagag

SEQ ID NO: 62 - DNA (other nucleic acid), 18 bp; single-stranded, linear
  description: /desc = "DNA (synthetic)"
gggctgcgcaaggtggcg

SEQ ID NO: 63 - DNA (other nucleic acid), 21 bp; single-stranded, linear
  description: /desc = "DNA (synthetic)"
acaccattgggccctgccagc

SEQ ID NO: 64 - DNA (other nucleic acid), 32 bp; single-stranded, linear
  description: /desc = "DNA (synthetic)"
gatcgaccatggcttacaagctgtgccacccc

SEQ ID NO: 65 - DNA (other nucleic acid), 36 bp; single-stranded, linear
  description: /desc = "DNA (synthetic)"
cgatcgaagcttattaggtggcacacagcttctcct

SEQ ID NO: 66 - DNA (other nucleic acid), 32 bp; single-stranded, linear
  description: /desc = "DNA (synthetic)"
gatcgaccatggctcccgagttgggtcccacc

SEQ ID NO: 67 - DNA (other nucleic acid), 36 bp; single-stranded, linear
  description: /desc = "DNA (synthetic)"
cgatcgaagcttattaggatatcccttccagggcct

SEQ ID NO: 68 - DNA (other nucleic acid), 32 bp; single-stranded, linear
  description: /desc = "DNA (synthetic)"
gatcgaccatggctatggcccctgccctgcag

SEQ ID NO: 69 - DNA (other nucleic acid), 36 bp; single-stranded, linear
  description: /desc = "DNA (synthetic)"
cgatcgaagcttattatcccagttcttccatctgct

SEQ ID NO: 70 - DNA (other nucleic acid), 32 bp; single-stranded, linear
  description: /desc = "DNA (synthetic)"
gatcgaccatggctacccagggtgccatgccg

SEQ ID NO: 71 - DNA (other nucleic acid), 36 bp; single-stranded, linear
  description: /desc = "DNA (synthetic)"
cgatcgaagcttattagggctgcagggcaggggcca

SEQ ID NO: 72 - DNA (other nucleic acid), 36 bp; single-stranded, linear; identical to SEQ ID NO: 71
  description: /desc = "DNA (synthetic)"

SEQ ID NO: 73 - DNA (other nucleic acid), 36 bp; single-stranded, linear
  description: /desc = "DNA (synthetic)"
cgatcgaagcttattaggcgaaggccggcatggcac

SEQ ID NO: 74 - DNA (other nucleic acid), 21 bp; single-stranded, linear
  description: /desc = "DNA (synthetic)"
gtagagggcggtggaggctcc

SEQ ID NO: 75 - DNA (other nucleic acid), 25 bp; single-stranded, linear
  description: /desc = "DNA (synthetic)"
ccggggagcctccaccgccctctac

SEQ ID NO: 76 - DNA (other nucleic acid), 53 bp; single-stranded, linear
  description: /desc = "DNA (synthetic)"
ttctacgccaccttgcgcagcccggcggcggctctgacatgtctacaccattg

SEQ ID NO: 77 - DNA (other nucleic acid), 53 bp; single-stranded, linear
  description: /desc = "DNA (synthetic)"
caatggtgtagacatgtcagagccgccgccgggctgcgcaaggtggcgtagaa

SEQ ID NO: 78 - DNA (other nucleic acid), 439 bp; single-stranded, linear
  description: /desc = "DNA (synthetic)"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgt

SEQ ID NO: 79 - DNA (other nucleic acid), 465 bp; single-stranded, linear
  description: /desc = "DNA (synthetic)"
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattc

SEQ ID NO: 80 - DNA (other nucleic acid), 927 bp; single-stranded, linear
  description: /desc = "DNA (synthetic)"
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaaggatcccaatgccatcttcctgagcttccaacacctgctccgaggaaaggtgcgtttcctgatgcttgtaggagggtccaccctctgcgtcagg

SEQ ID NO: 81 - DNA (other nucleic acid), 936 bp; single-stranded, linear
  description: /desc = "DNA (synthetic)"
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 82 - DNA (other nucleic acid), 939 bp; single-stranded, linear
  description: /desc = "DNA (synthetic)"
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 83 - DNA (other nucleic acid), 948 bp; single-stranded, linear
  description: /desc = "DNA (synthetic)"
tccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 84 - DNA (other nucleic acid), 688 bp; single-stranded, linear
  description: /desc = "DNA (synthetic)"
catggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtac

SEQ ID NO: 85 - DNA (other nucleic acid), 712 bp; unknown-stranded, unknown
  description: /desc = "SYNTHETIC"
catggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtac

SEQ ID NO: 86 - DNA (other nucleic acid), 975 bp; single-stranded, linear
  description: /desc = "DNA (synthetic)"
atggctctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 87 - DNA (other nucleic acid), 975 bp; single-stranded, linear; identical to SEQ ID NO: 86
  description: /desc = "DNA (synthetic)"

SEQ ID NO: 88 - DNA (other nucleic acid), 975 bp; single-stranded, linear
  description: /desc = "DNA (synthetic)"
atggctgcaccctctcgacatccaatcatcatcaaggcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggcctacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 89 - DNA (other nucleic acid), 975 bp; single-stranded, linear
  description: /desc = "DNA (synthetic)"
atggctgcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 90 - DNA (other nucleic acid), 999 bp; single-stranded, linear
  description: /desc = "DNA (synthetic)"
atggctctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 91 - DNA (other nucleic acid), 999 bp; single-stranded, linear
  description: /desc = "DNA (synthetic)"
atggctaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaatacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 92 - DNA (other nucleic acid), 999 bp; single-stranded, linear
  description: /desc = "DNA (synthetic)"
atggctgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggcctacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 93 - DNA (other nucleic acid), 999 bp; single-stranded, linear
  description: /desc = "DNA (synthetic)"
atggctgcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 94 - DNA (other nucleic acid), 918 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctaataa

SEQ ID NO: 95 - DNA (other nucleic acid), 963 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctaataa

SEQ ID NO: 96 - DNA (other nucleic acid), 918 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 97 - DNA (other nucleic acid), 963 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 98 - DNA (other nucleic acid), 918 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 99 - DNA (other nucleic acid), 963 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 100 - DNA (other nucleic acid), 918 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 101 - DNA (other nucleic acid), 963 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 102 - DNA (other nucleic acid), 918 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 103 - DNA (other nucleic acid), 963 bp; unknown-stranded, unknown
  description: /desc = "SYNTHETIC"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 104 - DNA (other nucleic acid), 927 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctaataa

SEQ ID NO: 105 - DNA (other nucleic acid), 972 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctaataa

SEQ ID NO: 106 - DNA (other nucleic acid), 927 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 107 - DNA (other nucleic acid), 972 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 108 - DNA (other nucleic acid), 927 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 109 - DNA (other nucleic acid), 972 bp; single-stranded, linear
  description: /desc = "DNA (synthetic)"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 110 - DNA (other nucleic acid), 927 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 111 - DNA (other nucleic acid), 972 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 112 - DNA (other nucleic acid), 927 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 113 - DNA (other nucleic acid), 972 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 114 - DNA (other nucleic acid), 963 bp; single-stranded, linear
  description: /desc = "synthetic"
atggctaactgctctaacatgatcgatgaaatcatcacccacctgaagcagccaccgctgccgctgctggacttcaacaacctcaatggtgaagaccaagatatcctaatggacaataaccttcgtcgtccaaacctcgaggcattcaaccgtgctgtcaagtctctgcagaatgcatcagcaattgagagcattcttaaaaatctcctgccatgtctgccgctagccacggccgcacccacgcgacatccaatccatatcaaggacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 115 - DNA (other nucleic acid), 972 bp; single-stranded, linear
  description: /desc = "synthetic"
atggctaactgctctaacatgatcgatgaaatcatcacccacctgaagcagccaccgctgccgctgctggacttcaacaacctcaatggtgaagaccaagatatcctgatggaaaataaccttcgtcgtccaaacctcgaggcattcaaccgtgctgtcaagtctctgcagaatgcatcagcaattgagagcattcttaaaaatctcctgccatgtctgcccctggccacggccgcacccacgcgacatccaatcatcatccgtgacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 116 - DNA (other nucleic acid), 963 bp; single-stranded, linear
  description: /desc = "synthetic"
atggctaactgctctaacatgatcgatgaaatcatcacccacctgaagcagccaccgctgccgctgctggacttcaacaacctcaatggtgaagaccaagatatcctgatggaaaataaccttcgtcgtccaaacctcgaggcattcaaccgtgctgtcaagtctctgcagaatgcatcagcaattgagagcattcttaaaaatctcctgccatgtctgcccctggccacggccgcacccacgcgacatccaatcatcatccgtgacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 117 - DNA (other nucleic acid), 972 bp; single-stranded, linear
  description: /desc = "synthetic"
atggctaactgctctaacatgatcgatgaaatcatcacccacctgaagcagccaccgctgccgctgctggacttcaacaacctcaatggtgaagaccaagatatcctaatggacaataaccttcgtcgtccaaacctcgaggcattcaaccgtgctgtcaagtctctgcagaatgcatcagcaattgagagcattcttaaaaatctcctgccatgtctgccgctagccacggccgcacccacgcgacatccaatccatatcaaggacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 118 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgccca

SEQ ID NO: 119 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccct

SEQ ID NO: 120 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacct

SEQ ID NO: 121 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcct

SEQ ID NO: 122 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtg

SEQ ID NO: 123 - DNA (other nucleic acid), 907 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatcggttacccttgagcaagcgcaggaacaacagtacgtagagggcggtggaggctccccggggaaccgtctggtccaatctctactatcaacccgtctcctccgtctaaagaatctcataaactccaaacatgggagaatggaaaacccagatggaggagaccaaggcacaggacattctggagcagtgacccttctgctggagggagtgatggcagcacggggacaactgggacccacttgctctcatccctcctggggcagctttctggacaggtccgtctcctccttggggccctgcaggcctccttggaacccagcttcctccacagggcaggaccacagctcacaaggatcccaatgcatcttcctgagcttccaacacctgctccgaggaaaggtgcgtttcctgatgcttgtagggggtccaccctctgcgtcagggaattcggcggcaacatggcgtctcccgctccgcctgctgtgacctccgagtcctcagtaaactgcttcgtgactcccatgtccttcacagcagactgaccagtgcccagaggttcaccctttgcctacacctgtcctgctgcctgctgtggactttagttg

SEQ ID NO: 124 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactg

SEQ ID NO: 125 - DNA (other nucleic acid), 848 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttg

SEQ ID NO: 126 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacag

SEQ ID NO: 127 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccaca

SEQ ID NO: 128 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaag

SEQ ID NO: 129 - DNA (other nucleic acid), 918 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaat

SEQ ID NO: 130 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgccca

SEQ ID NO: 131 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccct

SEQ ID NO: 132 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacct

SEQ ID NO: 133 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcct

SEQ ID NO: 134 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtg

SEQ ID NO: 135 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttg

SEQ ID NO: 136 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactg

SEQ ID NO: 137 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctcctt

SEQ ID NO: 138 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacag

SEQ ID NO: 139 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccaca

SEQ ID NO: 140 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaag

SEQ ID NO: 141 - DNA (other nucleic acid), 915 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaat

SEQ ID NO: 142 - DNA (other nucleic acid), 921 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttgacttccaaacctggagagcttcgtaagggctgtcaagaacttagaaaatgcatcaggtatgaggcaattcttcgtaatctccaaccatgtctgccctctgccacggccgcaccctctcgcatccaatcatcatcaaggcaggtgactggcaagaattccgggaaaaactgacgttctattggttacccttgagcaagcgcaggaacaacagtacgtagagggcggtggaggctccccggtaaccgtctggtccaatctctactatcaacccgtctcctccgtctaaagaatctcataaatctccaaacatggaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgccca

SEQ ID NO: 143 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccct

SEQ ID NO: 144 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacct

SEQ ID NO: 145 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcct

SEQ ID NO: 146 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtg

SEQ ID NO: 147 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttg

SEQ ID NO: 148 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactg

SEQ ID NO: 149 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctcctt

SEQ ID NO: 150 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacag

SEQ ID NO: 151 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccaca

SEQ ID NO: 152 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaag

SEQ ID NO: 153 - DNA (other nucleic acid), 927 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaat

SEQ ID NO: 154 - DNA (other nucleic acid), 906 bp; single-stranded, linear
  description: /desc = "synthetic"
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaag

SEQ ID NO: 155 - DNA (other nucleic acid), 993 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctaataa

SEQ ID NO: 156 - DNA (other nucleic acid), 993 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 157 - DNA (other nucleic acid), 993 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtcttctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 158 - DNA (other nucleic acid), 993 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 159 - DNA (other nucleic acid), 993 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtctacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 160 - DNA (other nucleic acid), 1027 bp; single-stranded, linear
  description: /desc = "synthetic"
atggctacaccattgggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattgggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccatcctggttgctagccatctgcagagcttcctggaggtgtcgtaccgcgttctacgccaccttgcgcagccctgataa

SEQ ID NO: 161 - protein, 155 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREF

SEQ ID NO: 162 - protein, 309 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHKDPNAIFLSFQHLLRGKVRFLMLVGGSTLCVR

SEQ ID NO: 163 - protein, 312 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVR

SEQ ID NO: 164 - protein, 313 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVR

SEQ ID NO: 165 - protein, 316 aa [sequence omitted]

SEQ ID NO: 166 - protein, 302 aa [sequence omitted]

SEQ ID NO: 167 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPSGGSGGSQSFLLKSLEQVRKIQGDGAALQEKLCAT

SEQ ID NO: 168 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAPELGPTLDTLQLDVADFATTIWQQMEELGMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 169 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAPELGPTLDTLQLDVADFATTIWQQMEELGMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 170 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 171 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 172 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 173 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 174 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 175 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 176 - protein, 305 aa [sequence omitted]

SEQ ID NO: 177 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPTPLGPASSLPQSFLLKSLEQVRKIQGDGAALQEKLCAT

SEQ ID NO: 178 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAPELGPTLDTLQLDVADFATTIWQQMEELGMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 179 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAPELGPTLDTLQLDVADFATTIWQQMEELGMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 180 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 181 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 182 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMATQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 183 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMATQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 184 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 185 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 186 - protein, 321 aa
LDPNNLNDEDVSILMDRNLRLPNLESFVRAVKNLENASGIEAILRNLQPCLPSATAAPSRHPIIIKAGDWQEFREKLTFYLVTLEQAQEQQGGGSNCSIMIDEIIHHLKRPPAPLYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 187 - protein, 321 aa
NASGIEAILRNLQPCLPSATAAPSRHPIIIKAGDWQEFREKLTFYLVTLEQAQEQQGGGSNCSIMIDEIIHHLKRPPAPLLDPNNLNDEDVSILMDRNLRLPNLESFVRAVKNLEYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 188 - protein, 321 aa
APSRHPIIIKAGDWQEFREKLTFYLVTLEQAQEQQGGGSNCSIMIDEIIHHLKRPPAPLLDPNNLNDEDVSILMDRNLRLPNLESFVRAVKNLENASGIEAILRNLQPCLPSATAYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 189 - protein, 321 aa
AGDWQEFREKLTFYLVTLEQAQEQQGGGSNCSIMIDEIIHHLKRPPAPLLDPNNLNDEDVSILMDRNLRLPNLESFVRAVKNLENASGIEAILRNLQPCLPSATAAPSRHPIIIKYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 190 - protein, 329 aa
LDPNNLNDEDVSILMDRNLRLPNLESFVRAVKNLENASGIEAILRNLQPCLPSATAAPSRHPIIIKAGDWQEFREKLTFYLVTLEQAQEQQGGGSGGGSGGGSNCSIMIDEIIHHLKRPPAPLYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 191 - protein, 329 aa
NASGIEAILRNLQPCLPSATAAPSRHPIIIKAGDWQEFREKLTFYLVTLEQAQEQQGGGSGGGSGGGSNCSIMIDEIIHHLKRPPAPLLDPNNLNDEDVSILMDRNLRLPNLESFVRAVKNLEYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 192 - protein, 329 aa
APSRHPIIIKAGDWQEFREKLTFYLVTLEQAQEQQGGGSGGGSGGGSNCSIMIDEIIHHLKRPPAPLLDPNNLNDEDVSILMDRNLRLPNLESFVRAVKNLENASGIEAILRNLQPCLPSATAYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 193 - protein, 299 aa
GGSGGGSNCSIMIDEIIHHLKRPPAPLLDPNNLNDEDVSILMDRNLRLPNLESFVRAVKNLENASGIEAILRNLQPCLPSATAAPSRHPIIIKYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 194 - protein, 329 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPGGGSDMATPLGPASSLPQSFLLKSLEQVRKIQGDGAALQEKLCAT

SEQ ID NO: 195 - protein, 329 aa [sequence omitted]

SEQ ID NO: 196 - protein, 329 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASAFQRRAGGVLVASHLQSFLEVSYRVLRHLAQPGGGSDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 197 - protein, 329 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAMAPALQPTQGAMPAFASAFQRRAGGVLVASHLQSFLEVSYRVLRHLAQPGGGSDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 198 - protein, 329 aa [sequence omitted]

SEQ ID NO: 199 - protein, 319 aa
MANCSNMIDEIITHLKQPPLPLLDFNNLNGEDQDILMDNNLRRPNLEAFNRAVKSLQNASAIESILKNLLPCLPLATAAPTRHPIHIKDGDWNEFRRKLTFYLKTLENAQAQQYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 200 - protein, 322 aa
MANCSNMIDEIITHLKQPPLPLLDFNNLNGEDQDILMENNLRRPNLEAFNRAVKSLQNASAIESILKNLLPCLPLATAAPTRHPIIIRDGDWNEFRRKLTFYLKTLENAQAQQYVEGGGGSPGEPSGPISTINPSPPSKESHKSPNMATQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 201 - protein, 319 aa
MANCSNMIDEIITHLKQPPLPLLDFNNLNGEDQDILMENNLRRPNLEAFNRAVKSLQNASAIESILKNLLPCLPLATAAPTRHPIIIRDGDWNEFRRKLTFYLKTLENAQAQQYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 202 - protein, 322 aa [sequence omitted]

SEQ ID NO: 203 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCP

SEQ ID NO: 204 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHP

SEQ ID NO: 205 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTP

SEQ ID NO: 206 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLP

SEQ ID NO: 207 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAV

SEQ ID NO: 208 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSL

SEQ ID NO: 209 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQL

SEQ ID NO: 210 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLL

SEQ ID NO: 211 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQ

SEQ ID NO: 212 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTT

SEQ ID NO: 213 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHK

SEQ ID NO: 214 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPN

SEQ ID NO: 215 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCP

SEQ ID NO: 216 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHP

SEQ ID NO: 217 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTP

SEQ ID NO: 218 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLP

SEQ ID NO: 219 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAV

SEQ ID NO: 220 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSL

SEQ ID NO: 221 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQL

SEQ ID NO: 222 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLL

SEQ ID NO: 223 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQ

SEQ ID NO: 224 - protein, 305 aa; identical to SEQ ID NO: 223

SEQ ID NO: 225 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHK

SEQ ID NO: 226 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPN

SEQ ID NO: 227 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHP

SEQ ID NO: 228 - protein, 309 aa; identical to SEQ ID NO: 227

SEQ ID NO: 229 - protein, 309 aa [sequence omitted]

SEQ ID NO: 230 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLP

SEQ ID NO: 231 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAV

SEQ ID NO: 232 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSL

SEQ ID NO: 233 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQL

SEQ ID NO: 234 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLL

SEQ ID NO: 235 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQ

SEQ ID NO: 236 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTT

SEQ ID NO: 237 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHK

SEQ ID NO: 238 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPN

SEQ ID NO: 239 - protein, 302 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHK

SEQ ID NO: 240 - DNA (other nucleic acid), 83 bp; single-stranded, linear; identical to SEQ ID NO: 46
  description: /desc = "synthetic"

SEQ ID NO: 241 - DNA (other nucleic acid), 83 bp; single-stranded, linear; identical to SEQ ID NO: 47
  description: /desc = "synthetic"

SEQ ID NO: 242 - protein, 8 aa
GGGSGGGS

SEQ ID NO: 243 - protein, 12 aa
GGGSGGGSGGGS

SEQ ID NO: 244 - protein, 7 aa
SGGSGGS

SEQ ID NO: 245 - protein, 6 aa
EFGNMA

SEQ ID NO: 246 - protein, 7 aa
EFGGNMA

SEQ ID NO: 247 - protein, 10 aa
EFGGNGGNMA

SEQ ID NO: 248 - protein, 7 aa
GGSDMAG

SEQ ID NO: 249 - DNA (other nucleic acid), 459 bp; unknown-stranded, unknown
  description: /desc = "SYNTHETIC"
tctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 250 - DNA (other nucleic acid), 447 bp; unknown-stranded, unknown
  description: /desc = "SYNTHETIC"
tctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaaggatcccaatgccatcttcctgagcttccaacacctgctccgaggaaaggtgcgtttcctgatgcttgtaggagggtccaccctctgcgtcagg

SEQ ID NO: 251 - DNA (other nucleic acid), 459 bp; unknown-stranded, unknown
  description: /desc = "SYNTHETIC"
tccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 252 - protein, 153 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVR

SEQ ID NO: 253 - protein, 149 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHKDPNAIFLSFQHLLRGKVRFLMLVGGSTLCVR

SEQ ID NO: 254 - protein, 153 aa; identical to SEQ ID NO: 252

SEQ ID NO: 255 - DNA (other nucleic acid), 64 bp; unknown-stranded, unknown
  description: /desc = "SYNTHETIC"
ggatccaccatgagccgcctgcccgtcctgctcctgctccaactcctggtccgccccgccatgg

SEQ ID NO: 256 - protein, 153 aa
  Modified-site 112: /note= "position 112 is deleted or Leu, Ala,VAl, Ile, Pro, Phe, Trp or Met"
  Modified-site 113: /note= "positoin 113 is deleted or Pro, Phe, Ala, Val, Leu, Ile, Trp or Met"
  Modified-site 114: /note= "position 114 is deleted or Pro, Phe, Ala, Val, Leu, Ile, Trp or Met"
  Modified-site 115: /note= "positon 115 is deleted or Gln, Gly, Ser, Thr, Tyr, or Asn"
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQXXXXGRTTAHKDPNAIFLSFQHLLRGKVRFLMLVGGSTLCVR

SEQ ID NO: 257 - DNA (other nucleic acid), 464 bp; unknown-stranded, unknown
  description: /desc = "SYNTHETIC"
ccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtaaggtaccgcatgcaagctt

SEQ ID NO: 258 - DNA (other nucleic acid), 100 bp; unknown-stranded, unknown
  description: /desc = "SYNTHETIC"
aaaacaagaagaaaggcgataaaaaggttgtggtaagagaaatggataaaaaggggtcggggaaggaaggtgggagttaaaaaagaggaagtaggtcaag

SEQ ID NO: 259 - DNA (other nucleic acid), 11808 bp; unknown-stranded, unknown
  description: /desc = "synthetic"
acgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctttaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccaacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgcccacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttaacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagcacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaaacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgacgtactccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcag

SEQ ID NO: 260 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccc

SEQ ID NO: 261 - DNA (other nucleic acid), 975 bp; unknown-stranded, unknown; identical to SEQ ID NO: 260
  description: /desc = "synthetic"

SEQ ID NO: 262 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtcttta

SEQ ID NO: 263 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtg

SEQ ID NO: 264 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggct

SEQ ID NO: 265 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagc

SEQ ID NO: 266 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggcc

SEQ ID NO: 267 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcag

SEQ ID NO: 268 - DNA (other nucleic acid), 975 bp; single-stranded, linear
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaa

SEQ ID NO: 269 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactg

SEQ ID NO: 270 - DNA (other nucleic acid), 975 bp; unknown-stranded, unknown
  description: /desc = "synthetic"
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcag

SEQ ID NO: 271 - protein, 325 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMALGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATP

SEQ ID NO: 272 - protein, 325 aa; identical to SEQ ID NO: 271

SEQ ID NO: 273 - protein, 325 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQS

SEQ ID NO: 274 - protein, 325 aa [sequence omitted]

SEQ ID NO: 275 - protein, 325 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMALLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELV

SEQ ID NO: 276 - protein, 325 aa [sequence omitted]

SEQ ID NO: 277 - protein, 325 aa [sequence omitted]

SEQ ID NO: 278 - protein, 325 aa [sequence omitted]

SEQ ID NO: 279 - protein, 325 aa [sequence omitted]

SEQ ID NO: 280 - protein, 325 aa [sequence omitted]

SEQ ID NO: 281 - protein, 325 aa [sequence omitted]

SEQ ID NO: 282 - protein, 325 aa [sequence omitted]

SEQ ID NO: 283 - protein, 153 aa
  Modified-site 7: /note= "Xaa at position 7 is Ser or Ala;"
  Modified-site 112: /note= "Xaa at position 112 is deleted or Leu, Ala, Val, Ile, Pro, Phe, Trp, or Met;"
  Modified-site 113: /note= "Xaa at position 113 is deleted or Pro, Phe, Ala, Val, Leu, Ile, Trp, or Met;"
  Modified-site 114: /note= "Xaa at position 114 is deleted or Pro, Phe, Ala, Val, Leu, Ile, Trp, or Met;"
  Modified-site 115: /note= "Xaa at position 115 is deleted or Gln, Gly, Ser, Thr, Tyr, or Asn;"
  Modified-site 151: /note= "Xaa at position 151 is Ser or Ala;"
SPAPPAXDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQXXXXGRTTAHKDPNAIFLSFQHLLRGKVRFLMLVGGSTLXVR

SEQ ID NO: 284 - protein, 162 aa
MAGRTTAHKDPNAIFLSFQHLLRGKVRFLMLVGGSTLAVREFGGNMASPAPPAADLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQ

SEQ ID NO: 285 - protein, 162 aa
MAGPTCLSSLLGQLSGQVRLLLGALQSLLGTQLPPQGRTTAHKDPNAIFLSFQHLLRGKVRFLMLVGGSTLAVREFGGNMASPAPPAADLRVLSKLLRDSHVLHSRLSQCPEVHPLPTPVLLPAVDFSLGEWKTQMEETKAQDILGAVTLLLEGVMAARGQL

SEQ ID NO: 286 - protein (peptide "), 180 aa
ATGGCTGGACCCACTTGCCTCTCATCCCTCCTGGGGCAGCTTTCTGGACAGGTCCGTCTCCTCCTTGGGGCCCTGCAGAGCCTCCTTGGAACCCAGCTTCCTCCACAGGGCAGGACCACAGCTCACAAGGATCCCAATGCCATCTTCCTGAGCTTCCAACACCTGCTCCGAGGAAAGGTG

SEQ ID NO: 287 - DNA (other nucleic acid), 486 bp; unknown-stranded, unknown
  description: /desc = "synthetic"
atggctggcaggaccacagctcacaaggatcccaatgccatcttcctgagcttccaacacctgctccgaggaaaggtgcgtttcctgatgcttgtaggagggtccaccctcgccgtcagggaattcggcggcaacatggcgtctccggcgccgcctgctgctgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacag

SEQ ID NO: 288 - DNA (other nucleic acid), 531 bp; unknown-stranded, unknown
  description: /desc = "synthetic"
cagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccc

SEQ ID NO: 289 - DNA (other nucleic acid), 531 bp; unknown-stranded, unknown
  description: /desc = "synthetic"
gaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaa

SEQ ID NO: 290 - DNA (other nucleic acid), 531 bp; unknown-stranded, unknown
  description: /desc = "synthetic"
ggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactg

SEQ ID NO: 291 - DNA (other nucleic acid), 531 bp; unknown-stranded, unknown
  description: /desc = "synthetic"
ttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagc

SEQ ID NO: 292 - DNA (other nucleic acid), 531 bp; unknown-stranded, unknown
  description: /desc = "synthetic"
agcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcag

SEQ ID NO: 293 - DNA (other nucleic acid), 531 bp; unknown-stranded, unknown; identical to SEQ ID NO: 292
  description: /desc = "synthetic"

SEQ ID NO: 294 - DNA (other nucleic acid), 531 bp; unknown-stranded, unknown
  description: /desc = "synthetic"
ttaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacacca

SEQ ID NO: 295 - DNA (other nucleic acid), 531 bp; unknown-stranded, unknown
  description: /desc = "synthetic"
ctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtg

SEQ ID NO: 296 - DNA (other nucleic acid), 531 bp; unknown-stranded, unknown
  description: /desc = "synthetic"
cccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggct

SEQ ID NO: 297 - DNA (other nucleic acid), 531 bp; unknown-stranded, unknown
  description: /desc = "synthetic"
caggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagc

SEQ ID NO: 298 - DNA (other nucleic acid), 531 bp; unknown-stranded, unknown
  description: /desc = "synthetic"
ctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggcc

SEQ ID NO: 299 - DNA (other nucleic acid), 531 bp; unknown-stranded, unknown
  description: /desc = "synthetic"
ctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcag

SEQ ID NO: 300 - protein, 177 aa
QSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLP

SEQ ID NO: 301 - protein, 177 aa
ELGMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQME

SEQ ID NO: 302 - protein, 177 aa
GMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEEL

SEQ ID NO: 303 - protein, 177 aa
FLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQS

SEQ ID NO: 304 - protein, 177 aa
SFLEVSYRVLRHLAQPDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQ

SEQ ID NO: 305 - protein, 177 aa
EQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQSFLLKSL

SEQ ID NO: 306 - protein, 177 aa
LGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATP

SEQ ID NO: 307 - protein, 177 aa
LLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELV

SEQ ID NO: 308 - protein, 177 aa
PLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELVLLGHSLGIPWA

SEQ ID NO: 309 - protein, 177 aa
QALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELVLLGHSLGIPWAPLSSCPS

SEQ ID NO: 310 - protein, 177 aa
LQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELVLLGHSLGIPWAPLSSCPSQA

SEQ ID NO: 311 - protein, 177 aa
LAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPDMATPLGPASSLPQSFLLKSLEQVRKIQGDGAALQEKLCATYKLCHPEELVLLGHSLGIPWAPLSSCPSQALQ

SEQ ID NO: 312 - protein, 177 aa
HLAQPDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLR

SEQ ID NO: 313 - DNA (other nucleic acid), 531 bp; unknown-stranded, unknown
  description: /desc = "synthetic"
caccttgcgcagcccgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgc

What is claimed is:

1. A hematopoietic protein comprising an amino acid sequence of the formula:

R1—L1—R2, R2—L1—R1, R1—R2, or R2—R1 wherein R1 is a biologically active human G-CSF comprising a modified amino acid sequence selected from the group consisting of:

(a) an amino acid sequence of (SEQ ID NO:1) wherein
Xaa at position 1 is Thr, Ser, Arg, Tyr or Gly;
Xaa at position 2 is Pro or Leu;
Xaa at position 3 is Leu, Arg, Tyr or Ser;
Xaa at position 13 is Phe, Ser, His, Thr or Pro;
Xaa at position 16 is Lys, Pro, Ser, Thr or His;
Xaa at position 17 is Cys, Ser, Gly, Ala, Ile, Tyr or Arg;
Xaa at position 18 is Leu, Thr, Pro, His, Ile or Cys;
Xaa at position 22 is Arg, Tyr, Ser, Thr or Ala;
Xaa at position 24 is Ile, Pro, Tyr or Leu;
Xaa at position 27 is Asp, or Gly;
Xaa at position 30 is Ala, Ile, Leu or Gly;
Xaa at position 34 is Lys or Ser;
Xaa at position 36 is Cys or Ser;
Xaa at position 42 is Cys or Ser;
Xaa at position 43 is His, Thr, Gly, Val, Lys, Trp, Ala, Arg, Cys, or Leu;
Xaa at position 44 is Pro, Gly, Arg, Asp, Val, Ala, His, Trp, Gln, or Thr;
Xaa at position 46 is Glu, Arg, Phe, Ile or Ala;
Xaa at position 47 is Leu or Thr;
Xaa at position 49 is Leu, Phe, Arg or Ser;
Xaa at position 50 is Leu, Ile, His, Pro or Tyr;
Xaa at position 54 is Leu or His;
Xaa at position 64 is Cys or Ser;
Xaa at position 67 is Gln, Lys, Leu or Cys;
Xaa at position 70 is Gln, Pro, Leu, Arg or Ser;
Xaa at position 74 is Cys or Ser;
Xaa at position 104 is Asp, Gly or Val;
Xaa at position 108 is Leu, Ala, Val, Arg, Trp, Gln or Gly;
Xaa at position 115 is Thr, His, Leu or Ala;
Xaa at position 120 is Gln, Gly, Arg, Lys or His;
Xaa at position 123 is Glu, Arg, Phe or Thr;
Xaa at position 144 is Phe, His, Arg, Pro, Leu, Gln or Glu;
Xaa at position 146 is Arg or Gln;
Xaa at position 147 is Arg or Gln;
Xaa at position 156 is His, Gly or Ser;
Xaa at position 159 is Ser, Arg, Thr, Tyr, Val or Gly;
Xaa at position 162 is Glu, Leu, Gly or Trp;
Xaa at position 163 is Val, Gly, Arg or Ala;
Xaa at position 169 is Arg, Ser, Leu, Arg or Cys;
Xaa at position 170 is His, Arg or Ser;
wherein optionally 1–11 amino acids from the N-terminus and 1–5 amino acids from the C-terminus can optionally be deleted from said modified human G-CSF amino acid sequence and wherein the N-terminus is joined to the C-terminus directly or through a linker (L2) capable of joining the N-terminus to the C-terminus wherein new C-termini and N-termini are created between the amino acid residue pairs of SEQ ID NO:1 selected from the group consisting of:
38–39, 39–40, 40–41, 41–42, 42–43, 43–44, 45–46, 48–49, 49–50, 52–53, 53–54, 54–55, 55–56, 56–57, 57–58, 58–59, 59–60, 60–61, 61–62, 62–63, 63–64, 64–65, 65–66, 66–67, 67–68, 69–70, 70–71, 71–72, 91–92, 92–93, 93–94, 94–95, 95–96, 96–97, 97–98, 98–99, 99–100, 123–124, 124–125, 125–126, 126–127, 127–128, 128–129, 129–130, 130–131, 131–132, 132–133, 133–134, 134–135, 135–136, 136–137, 137–138, 138–139, 139–140, 140–141, 141–142, and 142–143; and (b) an amino acid sequence of (SEQ ID NO:1) wherein
Xaa at position 1 is Thr, Ser, Arg, Tyr or Gly;
Xaa at position 2 is Pro or Leu;
Xaa at position 3 is Leu, Arg, Tyr or Ser;
Xaa at position 13 is Phe, Ser, His, Thr or Pro;
Xaa at position 16 is Lys, Pro, Ser, Thr or His;
Xaa at position 17 is Cys, Ser, Gly, Ala, Ile, Tyr or Arg;
Xaa at position 18 is Leu, Thr, Pro, His, Ile or Cys;
Xaa at position 22 is Arg, Tyr, Ser, Thr or Ala;
Xaa at position 24 is Ile, Pro, Tyr or Leu;
Xaa at position 27 is Asp, or Gly;
Xaa at position 30 is Ala, Ile, Leu or Gly;
Xaa at position 34 is Lys or Ser;
Xaa at position 36 is Cys or Ser;
Xaa at position 42 is Cys or Ser;
Xaa at position 43 is His, Thr, Gly, Val, Lys, Trp, Ala, Arg, Cys, or Leu;
Xaa at position 44 is Pro, Gly, Arg, Asp, Val, Ala, His, Trp, Gln, or Thr;
Xaa at position 46 is Glu, Arg, Phe, Arg, Ile or Ala;
Xaa at position 47 is Leu or Thr;
Xaa at position 49 is Leu, Phe, Arg or Ser;
Xaa at position 50 is Leu, Ile, His, Pro or Tyr;
Xaa at position 54 is Leu or His;
Xaa at position 64 is Cys or Ser;
Xaa at position 67 is Gln, Lys, Leu or Cys;
Xaa at position 70 is Gln, Pro, Leu, Arg or Ser;
Xaa at position 74 is Cys or Ser;
Xaa at position 104 is Asp, Gly or Val;
Xaa at position 108 is Leu, Ala, Val, Arg, Trp, Gln or Gly;
Xaa at position 115 is Thr, His, Leu or Ala;
Xaa at position 120 is Gln, Gly, Arg, Lys or His;
Xaa at position 123 is Glu, Arg, Phe or Thr;
Xaa at position 144 is Phe, His, Arg, Pro, Leu, Gln or Glu;
Xaa at position 146 is Arg or Gln;
Xaa at position 147 is Arg or Gln;
Xaa at position 156 is His, Gly or Ser;
Xaa at position 159 is Ser, Arg, Thr, Tyr, Val or Gly;

Xaa at position 162 is Glu, Leu, Gly or Trp;
Xaa at position 163 is Val, Gly, Arg or Ala;
Xaa at position 169 is Arg, Ser, Leu, Arg or Cys;
Xaa at position 170 is His, Arg or Ser;
wherein optionally 1–11 amino acids from the N-terminus and 1–5 amino acids from the C-terminus can be deleted and wherein the N-terminus is joined to the C-terminus directly or through a linker (L2) capable of joining the N-terminus to the C-terminus wherein new C-termini and N-termini are created between the amino acid residue pairs of SEQ ID NO:1 selected from the group consisting of: 2–3, 10–11, 12–13, 18–19, 122–123, 158–159, and 169–170;

R2 is a biologically active human IL-3 variant comprising a modified amino acid sequence of (SEQ ID NO:2)
wherein Xaa at position 17 is Ser, Lys, Gly, Asp, Met, Gln, or Arg;
Xaa at position 18 is Asn, His, Leu, Ile, Phe, Arg, or Gln;
Xaa at position 19 is Met, Phe, Ile, Arg, Gly, Ala, or Cys;
Xaa at position 20 is Ile, Cys, Gln, Glu, Arg, Pro, or Ala;
Xaa at position 21 is Asp, Phe, Lys, Arg, Ala, Gly, Glu, Gln, Asn, Thr, Ser or Val;
Xaa at position 22 is Glu, Trp, Pro, Ser, Ala, His, Asp, Asn, Gln, Leu, Val or Gly;
Xaa at position 23 is Ile, Val, Ala, Gly, Trp, Lys, Phe, Leu, Ser, or Arg;
Xaa at position 24 is Ile, Gly, Val, Arg, Ser, Phe, or Leu;
Xaa at position 25 is Thr, His, Gly, Gln, Arg, Pro, or Ala;
Xaa at position 26 is His, Thr, Phe, Gly, Arg, Ala, or Trp;
Xaa at position 27 is Leu, Gly, Arg, Thr, Ser, or Ala;
Xaa at position 28 is Lys, Arg, Leu, Gln, Gly, Pro, Val or Trp;
Xaa at position 29 is Gln, Asn, Leu, Pro, Arg, or Val;
Xaa at position 30 is Pro, His, Thr, Gly, Asp, Gln, Ser, Leu, or Lys;
Xaa at position 31 is Pro, Asp, Gly, Ala, Arg, Leu, or Gln;
Xaa at position 32 is Leu, Val, Arg, Gln, Asn, Gly, Ala, or Glu;
Xaa at position 33 is Pro, Leu, Gln, Ala, Thr, or Glu;
Xaa at position 34 is Leu, Val, Gly, Ser, Lys, Glu, Gln, Thr, Arg, Ala, Phe, Ile or Met;
Xaa at position 35 is Leu, Ala, Gly, Asn, Pro, Gln, or Val;
Xaa at position 36 is Asp, Leu, or Val;
Xaa at position 37 is Phe, Ser, Pro, Trp, or Ile;
Xaa at position 38 is Asn, or Ala;
Xaa at position 40 is Leu, Trp, or Arg;
Xaa at position 41 is Asn, Cys, Arg, Leu, His, Met, or Pro;
Xaa at position 42 is Gly, Asp, Ser, Cys, Asn, Lys, Thr, Leu, Val, Glu, Phe, Tyr, Ile, Met or Ala;
Xaa at position 43 is Glu, Asn, Tyr, Leu, Phe, Asp, Ala, Cys, Gln, Arg, Thr, Gly or Ser;
Xaa at position 44 is Asp, Ser, Leu, Arg, Lys, Thr, Met, Trp, Glu, Asn, Gln, Ala or Pro;
Xaa at position 45 is Gln, Pro, Phe, Val, Met, Leu, Thr, Lys, Trp, Asp, Asn, Arg, Ser, Ala, Ile, Glu or His;
Xaa at position 46 is Asp, Phe, Ser, Thr, Cys, Glu, Asn, Gln, Lys, His, Ala, Tyr, Ile, Val or Gly;
Xaa at position 47 is Ile, Gly, Val, Ser, Arg, Pro, or His;
Xaa at position 48 is Leu, Ser, Cys, Arg, Ile, His, Phe, Glu, Lys, Thr, Ala, Met, Val or Asn;
Xaa at position 49 is Met, Arg, Ala, Gly, Pro, Asn, His, or Asp;
Xaa at position 50 is Glu, Leu, Thr, Asp, Tyr, Lys, Asn, Ser, Ala, Ile, Val, His, Phe, Met or Gln;
Xaa at position 51 is Asn, Arg, Met, Pro, Ser, Thr, or His;
Xaa at position 52 is Asn, His, Arg, Leu, Gly, Ser, or Thr;
Xaa at position 53 is Leu, Thr, Ala, Gly, Glu, Pro, Lys, Ser, or Met;
Xaa at position 54 is Arg, Asp, Ile, Ser, Val, Thr, Gln, Asn, Lys, His, Ala or Leu;
Xaa at position 55 is Arg, Thr, Val, Ser, Leu, or Gly;
Xaa at position 56 is Pro, Gly, Cys, Ser, Gln, Glu, Arg, His, Thr, Ala, Tyr, Phe, Leu, Val or Lys;
Xaa at position 57 is Asn or Gly;
Xaa at position 58 is Leu, Ser, Asp, Arg, Gln, Val, or Cys;
Xaa at position 59 is Glu Tyr, His, Leu, Pro, or Arg;
Xaa at position 60 is Ala, Ser, Pro, Tyr, Asn, or Thr;
Xaa at position 61 is Phe, Asn, Glu, Pro, Lys, Arg, or Ser;
Xaa at position 62 is Asn, His, Val, Arg, Pro, Thr, Asp, or Ile;
Xaa at position 63 is Arg, Tyr, Trp, Lys, Ser, His, Pro, or Val;
Xaa at position 64 is Ala, Asn, Pro, Ser, or Lys;
Xaa at position 65 is Val, Thr, Pro, His, Leu, Phe, or Ser;
Xaa at position 66 is Lys, Ile, Arg, Val, Asn, Glu, or Ser;
Xaa at position 67 is Ser, Ala, Phe, Val, Gly, Asn, Ile, Pro, or His;
Xaa at position 68 is Leu, Val, Trp, Ser, Ile, Phe, Thr, or His;
Xaa at position 69 is Gln, Ala, Pro, Thr, Glu, Arg, Trp, Gly, or Leu;
Xaa at position 70 is Asn, Leu, Val, Trp, Pro, or Ala;
Xaa at position 71 is Ala, Met, Leu, Pro, Arg, Glu, Thr, Gln, Trp, or Asn;
Xaa at position 72 is Ser, Glu, Met, Ala, His, Asn, Arg, or Asp;
Xaa at position 73 is Ala, Glu, Asp, Leu, Ser, Gly, Thr, or Arg;
Xaa at position 74 is Ile, Met, Thr, Pro, Arg, Gly, Ala;
Xaa at position 75 is Glu, Lys, Gly, Asp, Pro, Trp, Arg, Ser, Gln, or Leu;
Xaa at position 76 is Ser, Val, Ala, Asn, Trp, Glu, Pro, Gly, or Asp;
Xaa at position 77 is Ile, Ser, Arg, Thr, or Leu;
Xaa at position 78 is Leu, Ala, Ser, Glu, Phe, Gly, or Arg;
Xaa at position 79 is Lys, Thr, Asn, Met, Arg, Ile, Gly, or Asp;
Xaa at position 80 is Asn, Trp, Val, Gly, Thr, Leu, Glu, or Arg;
Xaa at position 81 is Leu, Gln, Gly, Ala, Trp, Arg, Val, or Lys;
Xaa at position 82 is Leu, Gln, Lys, Trp, Arg, Asp, Glu, Asn, His, Thr, Ser, Ala, Tyr, Phe, Ile, Met or Val;
Xaa at position 83 is Pro, Ala, Thr, Trp, Arg, or Met;
Xaa at position 84 is Cys, Glu, Gly, Arg, Met, or Val;
Xaa at position 85 is Leu, Asn, Val, or Gln;
Xaa at position 86 is Pro, Cys, Arg, Ala, or Lys;
Xaa at position 87 is Leu, Ser, Trp, or Gly;
Xaa at position 88 is Ala, Lys, Arg, Val, or Trp;
Xaa at position 89 is Thr, Asp, Cys, Leu, Val, Glu, His, Asn, or Ser;

Xaa at position 90 is Ala, Pro, Ser, Thr, Gly, Asp, Ile, or Met;

Xaa at position 91 is Ala, Pro, Ser, Thr, Phe, Leu, Asp, or His;

Xaa at position 92 is Pro, Phe, Arg, Ser, Lys, His, Ala, Gly, Ile or Leu;

Xaa at position 93 is Thr, Asp, Ser, Asn, Pro, Ala, Leu, or Arg;

Xaa at position 94 is Arg, Ile, Ser, Glu, Leu, Val, Gln, Lys, His, Ala, or Pro;

Xaa at position 95 is His, Gln, Pro, Arg, Val, Leu, Gly, Thr, Asn, Lys, Ser, Ala, Trp, Phe, Ile, or Tyr;

Xaa at position 96 is Pro, Lys, Tyr, Gly, Ile, or Thr;

Xaa at position 97 is Ile, Val, Lys, Ala, or Asn;

Xaa at position 98 is His, Ile, Asn, Leu, Asp, Ala, Thr, Glu, Gln, Ser, Phe, Met, Val, Lys, Arg, Tyr or Pro;

Xaa at position 99 is Ile, Leu, Arg, Asp, Val, Pro, Gln, Gly, Ser, Phe, or His;

Xaa at position 100 is Lys, Tyr, Leu, His, Arg, Ile, Ser, Gln, or Pro;

Xaa at position 101 is Asp, Pro, Met, Lys, His, Thr, Val, Tyr, Glu, Asn, Ser, Ala, Gly, Ile, Leu, or Gln;

Xaa at position 102 is Gly, Leu, Glu, Lys, Ser, Tyr, or Pro;

Xaa at position 103 is Asp, or Ser;

Xaa at position 104 is Trp, Val, Cys, Tyr, Thr, Met, Pro, Leu, Gln, Lys, Ala, Phe, or Gly;

Xaa at position 105 is Asn, Pro, Ala, Phe, Ser, Trp, Gln, Tyr, Leu, Lys, Ile, Asp, or His;

Xaa at position 106 is Glu, Ser, Ala, Lys, Thr, Ile, Gly, or Pro;

Xaa at position 108 is Arg, Lys, Asp, Leu, Thr, Ile, Gln, His, Ser, Ala or Pro;

Xaa at position 109 is Arg, Thr, Pro, Glu, Tyr, Leu, Ser, or Gly;

Xaa at position 110 is Lys, Ala, Asn, Thr, Leu, Arg, Gln, His, Glu, Ser, or Trp;

Xaa at position 111 is Leu, Ile, Arg, Asp, or Met;

Xaa at position 112 is Thr, Val, Gln, Tyr, Glu, His, Ser, or Phe;

Xaa at position 113 is Phe, Ser, Cys, His, Gly, Trp, Tyr, Asp, Lys, Leu, Ile, Val or Asn;

Xaa at position 114 is Tyr, Cys, His, Ser, Trp, Arg, or Leu;

Xaa at position 115 is Leu, Asn, Val, Pro, Arg, Ala, His, Thr, Trp, or Met;

Xaa at position 116 is Lys, Leu, Pro, Thr, Met, Asp, Val, Glu, Arg, Trp, Ser, Asn, His, Ala, Tyr, Phe, Gln, or Ile;

Xaa at position 117 is Thr, Ser, Asn, Ile, Trp, Lys, or Pro;

Xaa at position 118 is Leu, Ser, Pro, Ala, Glu, Cys, Asp, or Tyr;

Xaa at position 119 is Glu, Ser, Lys, Pro, Leu, Thr, Tyr, or Arg;

Xaa at position 120 is Asn, Ala, Pro, Leu, His, Val, or Gln;

Xaa at position 121 is Ala, Ser, Ile, Asn, Pro, Lys, Asp, or Gly;

Xaa at position 122 is Gln, Ser, Met, Trp, Arg, Phe, Pro, His, Ile, Tyr, or Cys;

Xaa at position 123 is Ala, Met, Glu, His, Ser, Pro, Tyr, or Leu;

wherein from 1 to 14 amino acids can optionally be deleted from the N-terminus and/or from 1 to 15 amino acids can optionally be deleted from the C-terminus of said modified human IL-3 amino acid sequence; and wherein from 1 to 44 of the amino acids designated by Xaa are different from the corresponding amino acids of native (1–133) human interleukin-3;

and wherein $L_1$ is a linker capable of linking $R_1$ to $R_2$ and said hematopoietic protein can optionally be immediately preceded by (methionine$^{-1}$), (alanine$^{-1}$) or (methionine$^{-2}$, alanine$^{-1}$).

2. A hematopoietic protein of claim 1 wherein R1 is a biologically active human G-CSF comprising a modified an amino acid sequence of (SEQ ID NO:1) wherein Xaa at position 1 is Thr, Ser, Arg, Tyr or Gly;

Xaa at position 2 is Pro or Leu;

Xaa at position 3 is Leu, Arg, Tyr or Ser;

Xaa at position 13 is Phe, Ser, His, Thr or Pro;

Xaa at position 16 is Lys, Pro, Ser, Thr or His;

Xaa at position 17 is Cys, Ser, Gly, Ala, Ile, Tyr or Arg;

Xaa at position 18 is Leu, Thr, Pro, His, Ile or Cys;

Xaa at position 22 is Arg, Tyr, Ser, Thr or Ala;

Xaa at position 24 is Ile, Pro, Tyr or Leu;

Xaa at position 27 is Asp, or Gly;

Xaa at position 30 is Ala, Ile, Leu or Gly;

Xaa at position 34 is Lys or Ser;

Xaa at position 36 is Cys or Ser;

Xaa at position 42 is Cys or Ser;

Xaa at position 43 is His, Thr, Gly, Val, Lys, Trp, Ala, Arg, Cys, or Leu;

Xaa at position 44 is Pro, Gly, Arg, Asp, Val, Ala, His, Trp, Gln, or Thr;

Xaa at position 46 is Glu, Arg, Phe, Arg, Ile or Ala;

Xaa at position 47 is Leu or Thr;

Xaa at position 49 is Leu, Phe, Arg or Ser;

Xaa at position 50 is Leu, Ile, His, Pro or Tyr;

Xaa at position 54 is Leu or His;

Xaa at position 64 is Cys or Ser;

Xaa at position 67 is Gln, Lys, Leu or Cys;

Xaa at position 70 is Gln, Pro, Leu, Arg or Ser;

Xaa at position 74 is Cys or Ser;

Xaa at position 104 is Asp, Gly or Val;

Xaa at position 108 is Leu, Ala, Val, Arg, Trp, Gln or Gly;

Xaa at position 115 is Thr, His, Leu or Ala;

Xaa at position 120 is Gln, Gly, Arg, Lys or His

Xaa at position 123 is Glu, Arg, Phe or Thr

Xaa at position 144 is Phe, His, Arg, Pro, Leu, Gln or Glu;

Xaa at position 146 is Arg or Gln;

Xaa at position 147 is Arg or Gln;

Xaa at position 156 is His, Gly or Ser;

Xaa at position 159 is Ser, Arg, Thr, Tyr, Val or Gly;

Xaa at position 162 is Glu, Leu, Gly or Trp;

Xaa at position 163 is Val, Gly, Arg or Ala;

Xaa at position 169 is Arg, Ser, Leu, Arg or Cys;

Xaa at position 170 is His, Arg or Ser;

wherein optionally 1–11 amino acids from the N-terminus and 1–5 from the C-terminus can optionally be deleted from said modified human G-CSF amino acid sequence; and wherein the N-terminus is joined to the C-terminus directly or through a linker (L2) capable of joining the N-terminus to the C-terminus wherein new C-termini and N-termini are created between the amino acid reside pairs of SEQ ID NO:1 selected from the group consisting of:

38–39, 39–40, 40–41, 41–42, 42–43, 43–44, 45–46, 48–49, 49–50, 52–53, 53–54, 54–55, 55–56, 56–57, 57–58, 58–59, 59–60, 60–61, 61–62, 62–63, 63–64, 64–65, 65–66, 66–67, 67–68, 69–70, 70–71, 71–72, 91–92, 92–93, 93–94, 94–95, 95–96, 96–97, 97–98, 98–99, 99–100, 123–124, 124–125, 125–126, 126–127, 127–128, 128–129, 129–130, 130–131, 131–132, 132–133, 133–134, 134–135, 135–136, 136–137, 137–138, 138–139, 139–140, 140–141, 141–142, and 142–143.

3. A nucleic acid molecule encoding said hematopoietic protein of claim 2.

4. The hematopoietic protein of claim 1 wherein $R_2$ is a modified human IL-3 amino acid sequence of (SEQ ID NO:2)

wherein Xaa at position 17 is Ser, Lys, Gly, Asp, Met, Gln, or Arg;

Xaa at position 18 is Asn, His, Leu, Ile, Phe, Arg, or Gln;

Xaa at position 19 is Met, Phe, Ile, Arg, Gly, Ala, or Cys;

Xaa at position 20 is Ile, Cys, Gln, Glu, Arg, Pro, or Ala;

Xaa at position 21 is Asp, Phe, Lys, Arg, Ala, Gly, Glu, Gln, Asn, Thr, Ser or Val;

Xaa at position 22 is Glu, Trp, Pro, Ser, Ala, His, Asp, Asn, Gln, Leu, Val or Gly;

Xaa at position 23 is Ile, Val, Ala, Gly, Trp, Lys, Phe, Leu, Ser, or Arg;

Xaa at position 24 is Ile, Gly, Val, Arg, Ser, Phe, or Leu;

Xaa at position 25 is Thr, His, Gly, Gln, Arg, Pro, or Ala;

Xaa at position 26 is His, Thr, Phe, Gly, Arg, Ala, or Trp;

Xaa at position 27 is Leu, Gly, Arg, Thr, Ser, or Ala;

Xaa at position 28 is Lys, Arg, Leu, Gln, Gly, Pro, Val or Trp;

Xaa at position 29 is Gln, Asn, Leu, Pro, Arg, or Val;

Xaa at position 30 is Pro, His, Thr, Gly, Asp, Gln, Ser, Leu, or Lys;

Xaa at position 31 is Pro, Asp, Gly, Ala, Arg, Leu, or Gln;

Xaa at position 32 is Leu, Val, Arg, Gln, Asn, Gly, Ala, or Glu;

Xaa at position 33 is Pro, Leu, Gln, Ala, Thr, or Glu;

Xaa at position 34 is Leu, Val, Gly, Ser, Lys, Glu, Gln, Thr, Arg, Ala, Phe, Ile or Met;

Xaa at position 35 is Leu, Ala, Gly, Asn, Pro, Gln, or Val;

Xaa at position 36 is Asp, Leu, or Val;

Xaa at position 37 is Phe, Ser, Pro, Trp, or Ile;

Xaa at position 38 is Asn, or Ala;

Xaa at position 40 is Leu, Trp, or Arg;

Xaa at position 41 is Asn, Cys, Arg, Leu, His, Met, or Pro;

Xaa at position 42 is Gly, Asp, Ser, Cys, Asn, Lys, Thr, Leu, Val, Glu, Phe, Tyr, Ile, Met or Ala;

Xaa at position 43 is Glu, Asn, Tyr, Leu, Phe, Asp, Ala, Cys, Gln, Arg, Thr, Gly or Ser;

Xaa at position 44 is Asp, Ser, Leu, Arg, Lys, Thr, Met, Trp, Glu, Asn, Gln, Ala or Pro;

Xaa at position 45 is Gln, Pro, Phe, Val, Met, Leu, Thr, Lys, Trp, Asp, Asn, Arg, Ser, Ala, Ile, Glu or His;

Xaa at position 46 is Asp, Phe, Ser, Thr, Cys, Glu, Asn, Gln, Lys, His, Ala, Tyr, Ile, Val or Gly;

Xaa at position 47 is Ile, Gly, Val, Ser, Arg, Pro, or His;

Xaa at position 48 is Leu, Ser, Cys, Arg, Ile, His, Phe, Glu, Lys, Thr, Ala, Met, Val or Asn;

Xaa at position 49 is Met, Arg, Ala, Gly, Pro, Asn, His, or Asp;

Xaa at position 50 is Glu, Leu, Thr, Asp, Tyr, Lys, Asn, Ser, Ala, Ile, Val, His, Phe, Met or Gln;

Xaa at position 51 is Asn, Arg, Met, Pro, Ser, Thr, or His;

Xaa at position 52 is Asn, His, Arg, Leu, Gly, Ser, or Thr;

Xaa at position 53 is Leu, Thr, Ala, Gly, Glu, Pro, Lys, Ser, or Met;

Xaa at position 54 is Arg, Asp, Ile, Ser, Val, Thr, Gln, Asn, Lys, His, Ala or Leu;

Xaa at position 55 is Arg, Thr, Val, Ser, Leu, or Gly;

Xaa at position 56 is Pro, Gly, Cys, Ser, Gln, Glu, Arg, His, Thr, Ala, Tyr, Phe, Leu, Val or Lys;

Xaa at position 57 is Asn or Gly;

Xaa at position 58 is Leu, Ser, Asp, Arg, Gln, Val, or Cys;

Xaa at position 59 is Glu Tyr, His, Leu, Pro, or Arg;

Xaa at position 60 is Ala, Ser, Pro, Tyr, Asn, or Thr;

Xaa at position 61 is Phe, Asn, Glu, Pro, Lys, Arg, or Ser;

Xaa at position 62 is Asn, His, Val, Arg, Pro, Thr, Asp, or Ile;

Xaa at position 63 is Arg, Tyr, Trp, Lys, Ser, His, Pro, or Val;

Xaa at position 64 is Ala, Asn, Pro, Ser, or Lys;

Xaa at position 65 is Val, Thr, Pro, His, Leu, Phe, or Ser;

Xaa at position 66 is Lys, Ile, Arg, Val, Asn, Glu, or Ser;

Xaa at position 67 is Ser, Ala, Phe, Val, Gly, Asn, Ile, Pro, or His;

Xaa at position 68 is Leu, Val, Trp, Ser, Ile, Phe, Thr, or His;

Xaa at position 69 is Gln, Ala, Pro, Thr, Glu, Arg, Trp, Gly, or Leu;

Xaa at position 70 is Asn, Leu, Val, Trp, Pro, or Ala;

Xaa at position 71 is Ala, Met, Leu, Pro, Arg, Glu, Thr, Gln, Trp, or Asn;

Xaa at position 72 is Ser, Glu, Met, Ala, His, Asn, Arg, or Asp;

Xaa at position 73 is Ala, Glu, Asp, Leu, Ser, Gly, Thr, or Arg;

Xaa at position 74 is Ile, Met, Thr, Pro, Arg, Gly, Ala;

Xaa at position 75 is Glu, Lys, Gly, Asp, Pro, Trp, Arg, Ser, Gln, or Leu;

Xaa at position 76 is Ser, Val, Ala, Asn, Trp, Glu, Pro, Gly, or Asp;

Xaa at position 77 is Ile, Ser, Arg, Thr, or Leu;

Xaa at position 78 is Leu, Ala, Ser, Glu, Phe, Gly, or Arg;

Xaa at position 79 is Lys, Thr, Asn, Met, Arg, Ile, Gly, or Asp;

Xaa at position 80 is Asn, Trp, Val, Gly, Thr, Leu, Glu, or Arg;

Xaa at position 81 is Leu, Gln, Gly, Ala, Trp, Arg, Val, or Lys;

Xaa at position 82 is Leu, Gln, Lys, Trp, Arg, Asp, Glu, Asn, His, Thr, Ser, Ala, Tyr, Phe, Ile, Met or Val;

Xaa at position 83 is Pro, Ala, Thr, Trp, Arg, or Met;

Xaa at position 84 is Cys, Glu, Gly, Arg, Met, or Val;

Xaa at position 85 is Leu, Asn, Val, or Gln;

Xaa at position 86 is Pro, Cys, Arg, Ala, or Lys;

Xaa at position 87 is Leu, Ser, Trp, or Gly;

Xaa at position 88 is Ala, Lys, Arg, Val, or Trp;

Xaa at position 89 is Thr, Asp, Cys, Leu, Val, Glu, His, Asn, or Ser;

Xaa at position 90 is Ala, Pro, Ser, Thr, Gly, Asp, Ile, or Met;

Xaa at position 91 is Ala, Pro, Ser, Thr, Phe, Leu, Asp, or His;

Xaa at position 92 is Pro, Phe, Arg, Ser, Lys, His, Ala, Gly, Ile, or Leu;

Xaa at position 93 is Thr, Asp, Ser, Asn, Pro, Ala, Leu, or Arg;

Xaa at position 94 is Arg, Ile, Ser, Glu, Leu, Val, Gln, Lys, His, Ala, or Pro;

Xaa at position 95 is His, Gln, Pro, Arg, Val, Leu, Gly, Thr, Asn, Lys, Ser, Ala, Trp, Phe, Ile, or Tyr;

Xaa at position 96 is Pro, Lys, Tyr, Gly, Ile, or Thr;

Xaa at position 97 is Ile, Val, Lys, Ala, or Asn;

Xaa at position 98 is His, Ile, Asn, Leu, Asp, Ala, Thr, Glu, Gln, Ser, Phe, Met, Val, Lys, Arg, Tyr or Pro;

Xaa at position 99 is Ile, Leu, Arg, Asp, Val, Pro, Gln, Gly, Ser, Phe, or His;

Xaa at position 100 is Lys, Tyr, Leu, His, Arg, Ile, Ser, Gln, or Pro;

Xaa at position 101 is Asp, Pro, Met, Lys, His, Thr, Val, Tyr, Glu, Asn, Ser, Ala, Gly, Ile, Leu, or Gln;

Xaa at position 102 is Gly, Leu, Glu, Lys, Ser, Tyr, or Pro;

Xaa at position 103 is Asp, or Ser;

Xaa at position 104 is Trp, Val, Cys, Tyr, Thr, Met, Pro, Leu, Gln, Lys, Ala, Phe, or Gly;

Xaa at position 105 is Asn, Pro, Ala, Phe, Ser, Trp, Gln, Tyr, Leu, Lys, Ile, Asp, or His;

Xaa at position 106 is Glu, Ser, Ala, Lys, Thr, Ile, Gly, or Pro;

Xaa at position 108 is Arg, Lys, Asp, Leu, Thr, Ile, Gln, His, Ser, Ala or Pro;

Xaa at position 109 is Arg, Thr, Pro, Glu, Tyr, Leu, Ser, or Gly;

Xaa at position 110 is Lys, Ala, Asn, Thr, Leu, Arg, Gln, His, Glu, Ser, or Trp;

Xaa at position 111 is Leu, Ile, Arg, Asp, or Met;

Xaa at position 112 is Thr, Val, Gln, Tyr, Glu, His, Ser, or Phe;

Xaa at position 113 is Phe, Ser, Cys, His, Gly, Trp, Tyr, Asp, Lys, Leu, Ile, Val or Asn;

Xaa at position 114 is Tyr, Cys, His, Ser, Trp, Arg, or Leu;

Xaa at position 115 is Leu, Asn, Val, Pro, Arg, Ala, His, Thr, Trp, or Met;

Xaa at position 116 is Lys, Leu, Pro, Thr, Met, Asp, Val, Glu, Arg, Trp, Ser, Asn, His, Ala, Tyr, Phe, Gln, or Ile;

Xaa at position 117 is Thr, Ser, Asn, Ile, Trp, Lys, or Pro;

Xaa at position 118 is Leu, Ser, Pro, Ala, Glu, Cys, Asp, or Tyr;

Xaa at position 119 is Glu, Ser, Lys, Pro, Leu, Thr, Tyr, or Arg;

Xaa at position 120 is Asn, Ala, Pro, Leu, His, Val, or Gln;

Xaa at position 121 is Ala, Ser, Ile, Asn, Pro, Lys, Asp, or Gly;

Xaa at position 122 is Gln, Ser, Met, Trp, Arg, Phe, Pro, His, Ile, Tyr, or Cys;

Xaa at position 123 is Ala, Met, Glu, His, Ser, Pro, Tyr, or Leu;

wherein from 1 to 14 amino acids can optionally be deleted from the N-terminus and/or from 1 to 15 amino acids can optionally be deleted from the C-terminus of said modified human interleukin-3 amino acid sequence; and wherein from 0 to 44 of the amino acids designated by Xaa are different from the corresponding amino acids of native (1–133) human interleukin-3; wherein $L_1$ is a linker capable of linking $R_1$ to $R_2$; and said hematopoietic protein can optionally be immediately preceded by (methionine$^{-1}$), (alanine$^{-1}$) or (methionine$^{-2}$, alanine$^{-1}$).

5. A nucleic acid molecule encoding said hematopoietic protein of claim 4.

6. The hematopoietic protein as recited in claim 1 wherein said protein is selected from the group consisting of; (SEQ ID NO:166); (SEQ ID NO:167); (SEQ ID NO:168); (SEQ ID NO:169); (SEQ ID NO:170); (SEQ ID NO:171); (SEQ ID NO:172); (SEQ ID NO:173); (SEQ ID NO:174); (SEQ ID NO:175); (SEQ ID NO:176); (SEQ ID NO:177); (SEQ ID NO:179); (SEQ ID NO:181); (SEQ ID NO:182); (SEQ ID NO:183); (SEQ ID NO:184); (SEQ ID NO:195); (SEQ ID NO:196); (SEQ ID NO:197); and (SEQ ID NO:198).

7. A nucleic acid molecule encoding said hematopoietic protein of claim 6.

8. A nucleic acid molecule encoding said hematopoietic protein of claim 1.

9. The nucleic acid molecule according to claim 8 selected from group consisting of: (SEQ ID NO:94); (SEQ ID NO:95); (SEQ ID NO:96); (SEQ ID NO:97); (SEQ ID NO:98); (SEQ ID NO:99); (SEQ ID NO:100); (SEQ ID NO:101); (SEQ ID NO:102); (SEQ ID NO:107); (SEQ ID NO:103); (SEQ ID NO:104); (SEQ ID NO:105); (SEQ ID NO:109); (SEQ ID NO:110); (SEQ ID NO:111); (SEQ ID NO:112); (SEQ ID NO:155); (SEQ ID NO:156); (SEQ ID NO:157); (SEQ ID NO:158); and (SEQ ID NO:159).

10. A method of producing a hematopoietic protein comprising growing under suitable nutrient conditions a host cell transformed or transfected with a replicable vector comprising a nucleic acid molecule of claim 8, 3, 5, 7, or 9 that encodes the hematopoietic protein under conditions which result in the expression of said hematopoietic protein and recovering said hematopoietic protein.

11. The hematopoietic protein as recited in claim 1, 2, or 4 wherein said linker ($L_2$) is selected from the group consisting of;

GlyGlyGlySer (SEQ ID NO:12);
GlyGlyGlySerGlyGlyGlySer (SEQ ID NO:242);
GlyGlyGlySerGlyGlyGlySerGlyGlyGlySer (SEQ ID NO:243);
SerGlyGlySerGlyGlySer (SEQ ID NO:244);
GluPheGlyAsnMetAla (SEQ ID NO:245);
GluPheGlyGlyAsnMetAla (SEQ ID NO:246);
GluPheGlyGlyAsnGlyGlyAsnMetAla (SEQ ID NO:247); and
GlyGlySerAspMetAlaGly (SEQ ID NO:248).

12. A nucleic acid molecule encoding said hematopoietic protein of claim 11.

13. A method of producing a hematopoietic protein comprising growing under suitable nutrient conditions a host cell transformed or transfected with a replicable vector comprising a nucleic acid molecule of 12 that encodes the hematopoietic protein under conditions which result in the expression of said hematopoietic protein and recovering said hematopoietic protein.

14. A method of stimulating the production of hematopoietic cells in a patient comprising the step of administering to said patient an amount of the hematopoietic protein as recited in 11 effective to stimulate the production of hematopoietic cells.

15. A pharmaceutical composition comprising the hematopoietic protein according to claim 11 and a pharmaceutically acceptable carrier.

16. A pharmaceutical composition comprising the hematopoietic protein according to claim 11; at least one colony stimulating factor selected from the group consisting of GM-CSF, c-mpl ligand (TPO), M-CSF, erythropoietin (EPO), IL-1, IL-4, IL-2, IL 6, IL-7, IL-9, IL-11, LIF, flt3 ligand, and stem cell factor (SCF); and a pharmaceutically acceptable carrier.

17. A method for selective ex vivo expansion of hematopoietic cells comprising the steps of:
   (a) culturing hematopoietic cells with a culture medium comprising; an amount of the hematopoietic protein of claim 11 effective to expand said hematopoietic cells; and
   (b) harvesting the cultured hematopoietic cells of step (a).

18. A method for selective ex vivo expansion of hematopoietic stem cells comprising the steps of:
   (a) separating hematopoietic stem cells from other cells;
   (b) culturing the separated hematopoietic stem cells from step (a) with a selected culture medium comprising an amount of the hematopoietic protein of claim 11 effective to expand said hematopoietic stem cells; and
   (c) harvesting the cultured hematopoietic cells of step (b).

19. A method for treatment of a patient having a hematopoietic disorder comprising the steps of:
   (a) removing hematopoietic cells from said patient;
   (b) separating hematopoietic stem cells from other cells removed from said patient;
   (c) culturing said separated hematopoietic stem cells from step (b) with a selected culture medium comprising an amount of the hematopoietic protein of claim 11 effective to expand and/or differentiate the hematopoietic stem cells;
   (d) harvesting the cultured hematopoietic cells from step (c); and
   (e) introducing the cultured hematopoietic cells from step (d) into said patient to increase the number of hematopoietic cells.

20. A method of expanding and transducing human hematopoietic cells comprising the steps of:
   (a) removing hematopoietic cells from a patient;
   (b) separating hematopoietic stem cells from other cells removed from the patient in step (a);
   (c) culturing said separated hematopoietic stem cells from step (b) with a selected culture medium comprising an amount of the hematopoietic protein of claim 11 effective to expand the hematopoietic stem cells;
   (d) transducing the cultured hematopoietic cells from step (c) by introducing DNA into said cultured hematopoietic cells; and
   (e) harvesting said transduced hematopoietic cells.

21. A pharmaceutical composition comprising the hematopoietic protein according to claim 1, 2, 4, or 6 and a pharmaceutically acceptable carrier.

22. A pharmaceutical composition comprising the hematopoietic protein according to claim 1, 2, 4, or 6; at least one colony stimulating factor selected from the group consisting of GM-CSF, c-mpl ligand (TPO), M-CSF, erythropoietin (EPO), IL-1, IL-4, IL-2, IL 6, IL-7, IL-9, IL-11, LIF, flt3 ligand, and stem cell factor (SCF); and a pharmaceutically acceptable carrier.

23. A method of stimulating the production of hematopoietic cells in a patient comprising the step of administering to said patient an amount of the hematopoietic protein as recited in claim 1, 2, 4, or 6 effective to stimulate the production of hematopoietic cells.

24. A method for selective ex vivo expansion of hematopoietic cells comprising the steps of:
   (a) culturing hematopoietic cells with a culture medium comprising an amount of the hematopoietic protein of claim 1, 2, 4, or 6 effective to expand said hematopoietic cells; and
   (b) harvesting the cultured hematopoietic cells of step (a).

25. A method for selective ex vivo expansion of hematopoietic stem cells comprising the steps of:
   (a) separating hematopoietic stem cells from other cells;
   (b) culturing the separated hematopoietic stem cells from step (a) with a selected culture medium comprising an amount of the hematopoietic protein of claim 1, 2, 4, or 6 effective to expand said hematopoietic stem cells; and
   (c) harvesting the cultured hematopoietic cells of step (b).

26. A method for treatment of a patient having a hematopoietic disorder comprising the steps of:
   (a) removing hematopoietic cells from said patient;
   (b) separating hematopoietic stem cells from other cells removed from said patient;
   (c) culturing said separated hematopoietic stem cells from step (b) with a selected culture medium comprising an amount of the hematopoietic protein of claim 1, 2, 4, or 6 effective to expand and/or differentiate the hematopoietic stem cells;
   (d) harvesting the cultured hematopoietic cells from step (c); and
   (e) introducing the cultured hematopoietic cells from step (d) into said patient to increase the number of hematopoietic cells.

27. A method of expanding and transducing human hematopoietic cells comprising the steps of:
   (a) removing hematopoietic cells from a patient;
   (b) separating hematopoietic stem cells from other cells removed from the patient in step (a);
   (c) culturing said separated hematopoietic stem cells from step (b) with a selected culture medium comprising an amount of the hematopoietic protein of claim 1, 2, 4, or 6 effective to expand the hematopoietic stem cells;
   (d) transducing the cultured hematopoietic cells from step (c) by introducing DNA into said cultured hematopoietic cells; and
   (e) harvesting said transduced hematopoietic cells.

* * * * *